(12) United States Patent
Hellinga et al.

(10) Patent No.: US 11,906,524 B2
(45) Date of Patent: Feb. 20, 2024

(54) UREA BIOSENSORS AND USES THEREOF

(71) Applicant: Duke University, Durham, NC (US)

(72) Inventors: Homme W. Hellinga, Durham, NC (US); Malin J. Allert, Raleigh, NC (US)

(73) Assignee: Duke University, Durham, NC (US)

( * ) Notice: Subject to any disclaimer, the term of this patent is extended or adjusted under 35 U.S.C. 154(b) by 879 days.

(21) Appl. No.: 15/776,697

(22) PCT Filed: Nov. 19, 2016

(86) PCT No.: PCT/US2016/062960
§ 371 (c)(1),
(2) Date: May 16, 2018

(87) PCT Pub. No.: WO2017/087914
PCT Pub. Date: May 26, 2017

(65) Prior Publication Data
US 2020/0319194 A1 Oct. 8, 2020

Related U.S. Application Data

(60) Provisional application No. 62/257,834, filed on Nov. 20, 2015, provisional application No. 62/257,796, filed on Nov. 20, 2015.

(51) Int. Cl.
G01N 33/62 (2006.01)
C12Q 1/58 (2006.01)
G01N 21/64 (2006.01)
G01N 33/542 (2006.01)
C07K 14/195 (2006.01)
C07K 1/30 (2006.01)

(52) U.S. Cl.
CPC ............ G01N 33/62 (2013.01); C07K 14/195 (2013.01); C12Q 1/58 (2013.01); G01N 21/6428 (2013.01); G01N 33/542 (2013.01); C07K 1/306 (2013.01); C07K 2299/00 (2013.01); C07K 2319/20 (2013.01); G01N 2021/6439 (2013.01); G01N 2333/195 (2013.01); G01N 2333/47 (2013.01)

(58) Field of Classification Search
CPC ...... C07K 14/00; C07K 14/195; C07K 1/306; C07K 2299/00; C07K 2319/20; G01N 2021/6439; G01N 21/6428; G01N 33/542; G01N 33/62; G01N 2333/195; G01N 2333/47; C12Q 1/58
USPC ............... 436/18, 802, 518, 800, 89, 86; 422/82.08, 82.06; 435/69.7; 530/350; 536/23.4
See application file for complete search history.

(56) References Cited

U.S. PATENT DOCUMENTS

| 6,428,797 | B2 | 8/2002 | Fishman | |
| 7,118,921 | B1* | 10/2006 | Brennan | G01N 33/551 |
| | | | | 435/7.1 |
| 8,608,310 | B2 | 12/2013 | Otis et al. | |
| 2002/0004217 | A1 | 1/2002 | Hellinga | |
| 2004/0072369 | A1* | 4/2004 | Mobley | G01N 33/62 |
| | | | | 436/518 |
| 2004/0118681 | A1 | 6/2004 | Hellinga et al. | |
| 2004/0229290 | A1 | 11/2004 | Hellinga et al. | |
| 2008/0166747 | A1 | 7/2008 | Hellinga et al. | |
| 2009/0325221 | A1 | 12/2009 | Long et al. | |
| 2011/0171737 | A1 | 7/2011 | Hellinga et al. | |
| 2014/0256060 | A1 | 9/2014 | Ye et al. | |
| 2015/0111222 | A1 | 4/2015 | Marvin et al. | |
| 2016/0220686 | A1 | 8/2016 | Brudno et al. | |

FOREIGN PATENT DOCUMENTS

| WO | 2013052946 A2 | 4/2013 |
| WO | 2013154587 A1 | 10/2013 |
| WO | 2017/087912 A2 | 5/2017 |
| WO | 2017/087914 A2 | 5/2017 |

OTHER PUBLICATIONS

Van de Werken et al. ("Hydrogenomics of the extremely thermophilic bacterium Caldicellulosiruptor saccharolyticus." Applied and environmental microbiology vol. 74,21 (2008): 6720-9 (Year: 2008).*
Abouhamad et al. (Jun. 1991) "Peptide Transport and Chemotaxis in Escherichia coli and Salmonella typhimurium: Characterization of the Dipeptide Permease (Dpp) and the Dipeptide-Binding Protein", Molecular Microbiology, 5(5):1035-1047.
Adams et al. (Feb. 2010) "PHENIX: A Comprehensive Python-Based System for Macromolecular Structure Solution", Acta Crystallographica Section D, 66(Part 2):213-221.
Adey et al. (Apr. 14, 1995) "Characterization of Phage that Bind Plastic from Phage-Displayed Random Peptide Libraries", Gene, 156(1):27-31.
Adhikari et al. (Oct. 20, 1995) "Biochemical Characterization of a Haemophilus influenzae Periplasmic Iron Transport Operon", The Journal of Biological Chemistry, 270(42):25142-25149.
Allert et al. (Oct. 8, 2010) "Multifactorial Determinants of Protein Expression in Prokaryotic Open Reading Frames", Journal of Molecular Biology, 402(5):905-918.
Altschul et al. (Oct. 1990) "Basic Local Alignment Search Tool", Journal of Molecular Biology, 215(3):403-410.
Anraku (Jun. 10, 1968) "Transport of Sugars and Amino Acids in Bacteria", Journal of Biological Chemistry, 243 (11):3116-3122.
Artimo et al. (May 2012) "ExPASy: SIB Bioinformatics Resource Portal", Nucleic Acids Research, 40:W597-W603.

(Continued)

Primary Examiner — Shafiqul Haq
Assistant Examiner — Nam P Nguyen
(74) Attorney, Agent, or Firm — Nutter McClennen & Fish LLP

(57) ABSTRACT

The present subject matter provides urea biosensors as well as compositions, devices, and methods comprising such biosensors.

13 Claims, 213 Drawing Sheets

Specification includes a Sequence Listing.

(56) References Cited

OTHER PUBLICATIONS

Avvakumova et al. (Jan. 2014) "Biotechnological Approaches Toward Nanoparticle Biofunctionalization", Trends in Biotechnology, 32(1):11-20.
Baneyx et al. (Jul. 5, 2007) "Selection and Analysis of Solid-Binding Peptides", Current Opinion in Biotechnology, 18(4):312-317.
Barash et al. (Mar. 28, 1975) "Purification and Properties of Glutamate Binding Protein from the Periplasmic Space of *Escherichia coli* K-12", Biochimica et Biophysica Acta (BBA)—Protein Structure, 386(1):168-180.
Baskin et al. (Oct. 23, 2007) "Copper-Free Click Chemistry for Dynamic in Vivo Imaging", PNAS, 104 (43):16793-16797.
Beckers et al. (Nov. 2004) "Molecular Identification of the Urea Uptake System and Transcriptional Analysis of Urea Transporter- and Urease-Encoding Genes in Corynebacterium glutamicum", Journal of Bacteriology, 186 (22):7645-7652.
Benedetti et al. (Jul. 13, 2012) "Synthesis and Photophysical Properties of a Series of Cyclopenta[b]naphthalene Solvatochromic Fluorophores", Journal of the American Chemical Society, 134(30):12418-12421.
Berman et al. (2000) "The Protein Data Bank", Nucleic Acids Research, 28(1):235-242.
Biju et al. (Feb. 7, 2014) "Chemical Modifications and Bioconjugate Reactions of Nanomaterials for Sensing, Imaging, Drug Delivery and Therapy", Chemical Society Reviews, 43(3):744-764.
Bjorkman et al. (Jun. 12, 1998) "Multiple Open Forms of Ribose-Binding Protein Trace the Path of its Conformational Change", Journal of Molecular Biology, 279(3):651-664.
Bruns et al. (2001) "Crystallographic and Biochemical Analyses of the Metal-Free Haemophilus influenzae Fe3+-Binding Protein", Biochemistry, 40(51):15631-15637.
Bruns et al. (Nov. 1997) "Structure of Haemophilus Infuenzae Fe+3-Binding Protein Reveals Convergent Evolution within a Superfamily", Nature Structural Biology, 4(11):919-924.
Care et al. (May 2015) "Solid-Binding Peptides: Smart Tools for Nanobiotechnology", Trends in Biotechnology, 33(5):259-268.
Chen et al. (Feb. 2011) "Binding Analysis of Peptides That Recognize Preferentially Cis-Azobenzene Groups of Synthetic Polymers", Journal of Peptide Science, 17(2):163-168.
Chenna et al. (Jul. 2003) "Multiple Sequence Alignment with the Clustal Series of Programs", Nucleic Acids Research, 31(13):3497-3500.
Chothia et al. (1986) "The relation between the divergence of sequence and structure in proteins", The EMBO Journal, 5(4):823-826.
Clark et al. (Apr. 27, 1982) "Thermodynamics of the Binding of L-Arabinose the L-Arabinose-Binding Protein of *Escherichia* and of D-Galactose to Coli", Biochemistry, 21(9):2227-2233.
Cordingley et al. (Jun. 5, 1990) "Substrate Requirements of Human Rhinovirus 3C Protease for Peptide Cleavage in Vitro", The Journal of Biological Chemistry, 265(16):9062-9065.
Cox et al. (Mar. 2007) "Protein Fabrication Automation", Protein Science, 16(3):379-390.
Cuneo et al. (Nov. 27, 2009) "Structural Analysis of Semi-specific Oligosaccharide Recognition by a Cellulose-binding Protein of Thermotoga maritima Reveals Adaptations for Functional Diversification of the Oligopeptide Periplasmic Binding Protein Fold", The Journal of Biological chemistry, 284(48):33217-33223.
Database Genbank "Anabaena variabilis ATCC 29413, Complete Genome", NCBI Reference Sequence: NC_007413.1.
Database Genbank "*Bacillus* sp. JS, complete genome", NCBI Reference Sequence: NC_017743.1.
Database Genbank "Caldicellulosiruptor saccharolyticus DSM 8903, Complete Genome", NCBI Reference Sequence: NC_009437.1.
Database Genbank "Corynebacterium glutamicum MB001, Complete Genome", NCBI Reference Sequence: NC_022040.1.
Database Genbank "Desulfotomaculum nigrificans CO-1-SRB, Complete Sequence", NCBI Reference Sequence: NC_015565.1.
Database Genbank "Geobacillus kaustophilus HTA426 Dna, Complete Genome", NCBI Reference Sequence: NC_006510.1.
Database Genbank "Hungateiclostridium thermocellum ATCC 27405, Complete Sequence", NCBI Reference Sequence: NC_009012.1.
Database Genbank "Marinobacter hydrocarbonoclasticus str. ATCC 49840 Chromosome, Complete Genome", NCBI Reference Sequence: NC_017067.1.
Database Genbank "Marinomonas posidonica IVIA-Po-181, Complete Genome", NCBI Reference Sequence: NC_015559.1.
Database Genbank "*Paenibacillus* sp. Y412MC10, Complete Genome", NCBI Reference Sequence: NC_013406.1.
Database Genbank "Parageobacillus thermoglucosidasius C56-YS93, Complete Sequence", NCBI Reference Sequence: NC_015660.1.
Database Genbank "Thermocrinis albus DSM 14484, Complete Genome", NCBI Reference Sequence: NC_013894.1.
Database Genbank "Thermosynechococcus elongatus BP-1 chromosome, Complete Genome", NCBI Reference Sequence: NC_004113.
Date et al. (Feb. 2, 2011) "Polymer-Binding Peptides for the Noncovalent Modification of Polymer Surfaces: Effects of Peptide Density on the Subsequent Immobilization of Functional Proteins", ACS Applied Materials & Interfaces, 3(2):351-359.
De Lorimier et al. (2002) "Construction of a Fluorescent Biosensor Family", Protein Science, 11:2655-2575.
Demchenko (Dec. 5, 2014) "Practical Aspects of Wavelength Ratiometry in the Studies of Intermolecular Interactions", Journal of Molecular Structure, 1077:51-67.
Demchenko (Sep. 2010) "The Concept of λ-Ratiometry in Fluorescence Sensing and Imaging", Journal of Fluorescence, 20(5):1099-1128.
Dunten (Nov. 1995) "Crystal Structure of the Dipeptide Binding Protein From *Escherichia coli* Involved in Active Transport and Chemotaxis", Protein Science, 4(11):2327-2334.
Duplay et al. (Aug. 25, 1984) "Sequences of the malE Gene and of its Product, the Maltose-binding Protein of *Escherichia coli* K12", The Journal of Biological Chemistry, 259(16):10606-10613.
Dwyer et al. (2004) "Periplasmic Binding Proteins: A Versatile Superfamily for Protein Engineering", Current Opinion in Structural Biology, 14:495-504.
Zeng et al. (2014) "Nanomaterials Enhanced Surface Plasmon Resonance for Biological and Chemical Sensing Applications", Chemical Society Reviews, 43(10):3426-3452.
Ejima et al. (Oct. 15, 2010) "Biological Identification of Peptides that Specifically Bind to Poly(phenylene vinylene) Surfaces: Recognition of the Branched or Linear Structure of the Conjugated Polymer", Langmuir, 26 (22):17278-17285.
Emsley et al. (2004) "Coot: Model-Building Tools for Molecular Graphics", Acta Crystallographica Section D, 60:2126-2132.
Borrok et al., Conformational Changes of Glucose/Galactose-binding Protein Illuminated by Open, Unliganded, and Ulta-High-Resolution Ligand-Bound Structures, Protein Sci (Jun. 2007), vol. 16, No. 6, pp. 1032-1041.
Scognamiglio et al., D-Galactose/D-Glucose-Binding Protein Form *Escherichia coli* as Probe for a Non-Consuming Implantable Fluorescence Biosensor, Sensors (Oct. 24, 2007), vol. 7, No. 10, pp. 2484-2494.
UniProt A4XMB7 (www.uniprot.org/uniprot/A4XMB7) May 29, 2007, A4XMB7-1 sequence, gram-positive *Caldicellulosiruptor* species.
Valladares et al., An ABC-Type, High-Affinity Urea Permease Identified in Cyanobacteria, Molecular Microbiology (Feb. 2002), vol. 43, No. 3, pp. 703-715.
Gill et al. (Nov. 1, 1989) "Calculation of Protein Extinction Coefficients from Amino Acid Sequence Data", Analytical Biochemistry, 182(2):319-326.
Gough et al. (Sep. 1995) "Development of the Implantable Glucose Sensor: What Are the Prospects and Why Is It Taking So Long?", Diabetes, 44(9):1005-1009.
Grimley et al. (Oct. 9, 2013) "Visualization of Synaptic Inhibition with an Optogenetic Sensor Developed by Cell-Free Protein Engineering Automation", The Journal of Neuroscience, 33(41):16297-16309.

(56) References Cited

OTHER PUBLICATIONS

Groarke et al. (Nov. 1983) "The Amino Acid Sequence of D-Ribose-binding Protein from *Escherichia coli* K12", Journal of Biological Chemistry, 258(21):12952-12956.

Nathan et al. (Sep. 30, 1993) "The Effect of Intensive Treatment of Diabetes on the Development and Progression of Long-Term Complications in Insulin-Dependent Diabetes Mellitus", The New England Journal of Medicine, 329:977-986.

Gunay et al. (Oct. 21, 2015) "Identification of Soft Matter Binding Peptide Ligands Using Phage Display", Bioconjugate Chemistry, 26(10):2002-2015.

Guo et al. (Jun. 10, 2013) "Identification and Characterization of a Cellulose Binding Heptapeptide Revealed by Phage Display", Biomacromolecules, 14(6):1795-1805.

Guyer et al. (Nov. 1986) "Binding Specificity of the Periplasmic Oligopeptide-Binding Protein from *Escherichia coli*", Journal of Bacteriology, 168(2):775-779.

He et al. (1993) "Dominant Role of Local Dipoles in Stabilizing Uncompensated Charges on a Sulfate Sequestered in a Periplasmic Active Transport Protein", Protein Science, 2:1643-1647.

Hellinga et al. (Jul. 1985) "Nucleotide Sequence and High-Level Expression of the Major *Escherichia coli* Phosphofructokinase", European Journal of Biochemistry, 149(2)363-373.

Hengen (Jul. 1995) "Paul N Purification of His-Tag Fusion Proteins from *Escherichia coli*", Trends in Biochemical Sciences, 20(7):285-286.

Heo et al. (Jan. 2013) "Towards Smart Tattoos: Implantable Biosensors for Continuous Glucose Monitoring", Advanced Healthcare Materials, 2(1):43-56.

Hnilova et al. (2012) "Peptide-Directed Co-Assembly of Nanoprobes on Multimaterial Patterned Solid Surfaces", Soft Matter, 8(16):4327-4334.

Hsiao et al. (Sep. 20, 1996) "The Crystal Structure of Glutamine-binding Protein from *Escherichia coli*", Journal of Molecular Biology, 262(2):225-242.

Jacobson et al. (Dec. 5, 1998) "Sulfate-Binding Protein Dislikes Protonated Oxyacids. A Molecular Explanation", Journal of Molecular Biology, 204(3):783-787.

Joshi et al. (Jan. 29, 1998) "*Escherichia coli* Lysine-Arginine-Ornithine(LAO)-Binding Periplasmic Protein Argt (Argt) Gene, Partial Cds, Histidine-Binding Periplasmic Protein Hisj (Hisj) and Histidine Transport System Permease Protein Hisq (Hisq) Genes, Complete Cds, and Histidine Tran", GenBank: U47027.1, 2 pages.

Judge et al. (Feb. 27, 2011) "Continuous Glucose Monitoring Using a Novel Glucose/Galactose Binding Protein: Results of a 12-Hour Feasibility Study with the Becton Dickinson Glucose/Galactose Binding Protein Sensor", Diabetes Technology & Therapeutics, 13(3):309-317.

Kabsch (2010) "XDS", Acta Crystallographica Section D Biological Crystallography, D66:125-132.

Klymchenko et al. (Jan. 1, 2013) "Fluorescent Environment-Sensitive Dyes as Reporters of Biomolecular Interactions", Progress in Molecular Biology and Translational Science, 113:35-58.

Kolb et al. (Jun. 1, 2001) "Click Chemistry: Diverse Chemical Function from a Few Good Reactions", Angewandte Chemie International Edition, 40(11):2004-2021.

Koo et al. (Nov. 19, 2012) "Bioorthogonal Copper-Free Click Chemistry In Vivo for Tumor-Targeted Delivery of Nanoparticles", Angewandte Chemie, 51(47):11836-11840.

Kucherak et al. (Jan. 12, 2010) "Fluorene Analogues of Prodan with Superior Fluorescence Brightness and Solvatochromism", The Journal of Physical Chemistry Letters, 1(3):616-620.

Kumada et al. (Dec. 14, 2009) "Characterization of Polystyrene-Binding Peptides (PS-tags) for Site-Specific Immobilization of Proteins", Journal of Bioscience and Bioengineering, 109(6):583-587.

Kumada et al. (Aug. 31, 2012) "Screening of PC and PMMA-Binding Peptides for Site-Specific Immobilization of Proteins", Journal of Biotechnology, 160(3-4):222-228.

Kumada (Nov. 2014) "Site-Specific Immobilization of Recombinant Antibody Fragments Through Material-Binding Peptides for the Sensitive Detection of Antigens in Enzyme Immunoassays", Biochimica et Biophysica Acta (BBA)—Proteins and Proteomics, 1844(11):1960-1969.

Kumar et al. (Oct. 15, 2015) "Non-Enzymatic Detection of Urea using Unmodified Gold Nanoparticles Based Aptasensor", Biosensors and Bioelectronics, 72:340-347.

Layton et al. (Nov. 4, 2010) "Thermodynamic Analysis of Ligand-Induced Changes in Protein Thermal Unfolding Applied to High-Throughput Determination of Ligand Affinities with Extrinsic Fluorescent Dyes", Biochemistry, 49(51):10831-10841.

Ledvina et al. (Jun. 1996) "Negative Electrostatic Surface Potential of Protein Sites Specific for Anionic Ligands", Proceedings of the National Academy of Sciences, 93:6786-6791.

Lee et al. (Jun. 2002) "Ordering of Quantum Dots Using Genetically Engineered Viruses", Science, 296(5569):892-895.

Liepinsh et al. (Oct. 1, 1994) "Specificity of Urea Binding to Proteins", Journal of the American Chemical Society, 116(21):9670-9674.

Lu et al. (Nov. 23, 2006) "Long-Wavelength Analogue of PRODAN: Synthesis and Properties of Anthradan, a Fluorophore with a 2,6-Donor-Acceptor Anthracene Structure", The Journal of Organic Chemistry, 71(26):9651-9657.

Luecke et al. (Sep. 27, 1990) "High Specificity of a Phosphate Transport Protein Determined by Hydrogen Bonds", Nature, 347:402-406.

Magota et al. (Mar. 1984) "Nucleotide Sequence of the phoS Gene, the Structural Gene for the Phosphate-Binding Protein of *Escherichia coli*", Journal of Bacteriology, 157(3):909-917.

Marvin et al. (1998) "Engineering Biosensors by Introducing Fluorescent Allosteric Signal Transducers: Construction of a Novel Glucose Sensor", Journal of the American Chemical Society, 120:7-11.

Marvin et al. (Sep. 2001) "Manipulation of Ligand Binding Affinity by Exploitation of Conformational Coupling", Nature Structural & Molecular Biology, 8(9):795-798.

Marvin et al. (Apr. 1997) "The Rational Design of Allosteric Interactions in a Monomeric Protein and its Applications to the Construction of Biosensors", Proceedings of the National Academy of Sciences, 94:4366-4371.

Matsuno et al. (May 24, 2008) "Biological Selection of Peptides for Poly(I-lactide) Substrates", Langmuir, 24(13):6399-6403.

McDonagh et al. (Jan. 30, 2008) "Optical Chemical Sensors", Chemical Reviews, 108(2):400-422.

Medintz et al. (Jun. 1, 2005) "Quantum Dot Bioconjugates for Imaging, Labelling and Sensing", Nature Materials, 4:435-446.

Medveczky et al. (Nov. 18, 1969) "The Binding and Release of Phosphate by a Protein Isolated from *Escherichia coli*", Biochimica et Biophysica Acta (BBA)—General Subjects, 192(2):369-371.

Meyerhoff et al. (1966) "Current Status of the Glucose Sensor", Endricon, 6(1):51-58.

Miller et al. (Nov. 25, 1983) "Rates of Ligand Binding to Periplasmic Proteins Involved in Bacterial Transport and Chemotaxis", The Journal of Biological Chemistry, 258(22)13665-13672.

Mowbray et al. (May 5, 1992) "1.7 A X-Ray Structure of the Periplasmic Ribose Receptor from *Escherichia coli*", Journal of Molecular Biology, 225(1):155-175.

Nanavati et al. (Feb. 2006) "Several Archaeal Homologs of Putative Oligopeptide-Binding Proteins Encoded by Thermotoga maritima Bind Sugars", Applied and Environmental Biology, 72(2):1336-1345.

Neves et al. (Jun. 19, 2013) "Imaging Cell Surface Glycosylation in Vivo Using "Double Click" Chemistry", Bioconjugate chemistry, 24(6):934-941.

Nickitenko (Dec. 1995) "2 A Resolution Structure of DppA, a Periplasmic Dipeptide Transport/Chemosensory Receptor", Biochemistry, 34(51):16585-16595.

Niko et al. (Jul. 22, 2013) "Solvatochromic Pyrene Analogues of Prodan Exhibiting Extremely High Fluorescence Quantum Yields in Apolar and Polar Solvents", Chemistry, 19(30):9760-9765.

(56) References Cited

OTHER PUBLICATIONS

Nohno et al. (1986) "Cloning and Complete Nucleotide Sequence of the *Escherichia coli* Glutamine Permease Operon (Glnhpq)", Molecular Genetics and Genomics, 205:260-269.

Nwe et al. (2009) "Growing Applications of "Click Chemistry" for Bioconjugation in Contemporary Biomedical Research", Cancer Biotherapy and Radiopharmaceuticals, 24(3):289-302.

Oliveira et al. (Aug. 2015) "Recombinant CBM-Fusion Technology—Applications Overview", Biotechnology Advances, May 33(3-4):358-369.

Oneto et al. (2014) "Implantable Biomaterial Based on Click Chemistry for Targeting Small Molecules", Acta Biomaterilia, 10:5099-5105.

Osbourn et al. (Dec. 2009) "Operons", Cellular and Molecular Life Sciences, 66(23):3755-3775.

Overbeek et al. (Mar. 16, 1999) "The Use of Gene Clusters to Infer Functional Coupling", PNAS, 96(6):2896-2901.

Parashar et al. (Mar. 27, 2015) "Urease Immobilized Fluorescent Gold Nanoparticles for Urea Sensing", Biotechnology and Applied Biochemistry, 176(2):480-492.

Pearl et al. (Dec. 1, 1994) "Crystal Structure of AmiC: The Controller of Transcription Antitermination in the Amidase Operon of Pseudomonas aeruginosa", The EMBO Journal, 13(24):5810-5817.

Pflugrath et al. (Mar. 21, 1985) "Sulphate Sequestered in the Sulphate-Binding Protein of *Salmonella typhimurium* is Bound Solely by Hydrogen Bonds", Nature, 314:257-260.

Pickup (1993) "Developing Glucose Sensors for In Vivo Use", Tibtech, 11:285-291.

Quiocho et al. (Aug. 15, 1997) "Extensive Features of Tight Oligosaccharide Binding Revealed in High-Resolution Structures of the Maltodextrin Transport/Chemosensory Receptor", Structure, 5(8):997-1015.

Quiocho et al. (Aug. 2, 1984) "Novel Stereospecificity of the L-Arabinose-Binding Protein", Nature, 310:381-386.

Resch-Genger et al. (Oct. 2008) "Quantum Dots Versus Organic Dyes as Fluorescent Labels", Nature Methods, 5(9):763-775.

Riklin et al. (Aug. 24, 1995) "Improving Enzyme—Electrode Contacts by Redox Modification of Cofactors", Nature, 376:672-675.

Rossin et al. (Apr. 10, 2010) "In Vivo Chemistry for Pretargeted Tumor Imaging in Live Mice", Angewandte Chemie, 49(19):3375-3378.

Sanders et al. (Oct. 1994) "Identification of a Locus Involved in the Utilization of Iron by Haemophilus Influenzae", Infection and Immunity, 62(10):4515-4525.

Sangawa et al. (2013) "A Multipurpose Fusion Tag Derived from an Unstructured and Hyperacidic Region of the Amyloid Precursor Protein", Protein science, 22:840-850.

Sapsford et al. (Jul. 10, 2006) "Materials for Fluorescence Resonance Energy Transfer Analysis: Beyond Traditional Donor-Acceptor Combinations", Angew Chem Int Ed Engl, 45(28):4562-4589.

Scholle et al. (Jun. 1987) "Sequence of the Mglb Gene from *Escherichia coli* K12: Comparison of Wild-Type and Mutant Galactose Chemoreceptors", Molecular and General Genetics MGG, 208(1-2):247-253.

Schwartz et al. (1976) "Further Studies on the Binding of Maltose to the Maltose-Binding Protein of *Escherichia coli*", European Journal of Biochemistry, 71:167-170.

Scripture et al. (Sep. 5, 1987) "High-Affinity L-Arabinose Transport Operon. Nucleotide Sequence and Analysis of Gene Products", Journal of Molecular Biology, 197(1):37-46.

Serizawa et al. (Sep. 15, 2005) "A Peptide Motif Recognizing a Polymer Stereoregularity", Journal of the American Chemical Society, 127(40):13780-13781.

Serizawa et al. (Oct. 23, 2007) "Highly Specific Affinities of Short Peptides Against Synthetic Polymers", Langmuir, 23(22):11127-11133.

Serizawa et al. (Jun. 18, 2007) "Isolation of Peptides that Can Recognize Syndiotactic Polystyrene", Chembiochem, 8(9):989-993.

Serizawa et al. (2007) "Peptide Motifs that Recognize Differences in Polymer-Film Surfaces", Angew Chem Int Ed Engl, 46(5):723-726.

Sharff et al. (Nov. 10, 1992) "Crystallographic Evidence of a Large Ligand-Induced Hinge-Twist Motion between the two Domains of the Maltodextrin Binding Protein Involved in Active Transport and Chemotaxis", Biochemistry, 31(44):10657-10663.

Shen et al. (Dec. 21, 2015) "Fluorescence Enhancement on Silver Nanoplates at the Single- and Sub-Nanoparticle Level", Nanoscale, 7(47):20132-20141.

Shin et al. (2005) "Chemical structure and physical properties of cyclic olefin copolymers (IUPAC Technical Report)", Pure and Applied Chemistry, 77(5):801-814.

Shoseyov et al. (Jun. 2006) "Carbohydrate Binding Modules: Biochemical Properties and Novel Applications", Microbiology and Molecular Biology Reviews, 70(2):283-295.

Yao et al. (Apr. 26, 1994) "Refined 1.89-A Structure of the Histidine-Binding Protein Complexed with Histidine and its Relationship with Many Other Active Transport/Chemosensory Proteins", Biochemistry, 33(16):4769-4779.

Smith et al. (2005) "Orthogonal Site-Specific Protein Modification by Engineering Reversible Thiol Protection Mechanisms", Protein Science, 14:64-73.

Smith et al. (1999) "Substrate Specificity of the Periplasmic Dipeptide-Binding Protein from *Escherichia coli*: Experimental Basis for the Design of Peptide Prodrugs", Microbiology, 145:2891-2901.

Spurlino et al. (Mar. 15, 1991) "The 2.3-A Resolution Structure of the Maltose- or Maltodextrinbinding Protein, A Primary Receptor of Bacterial Active Transport and Chemotaxis", Journal of Biological Chemistry, 266(8):5202-5219.

Suleiman et al. (Oct. 23, 1992) "Biosensors for Food Analysis", Biosensor Design and Application, 511:26-40.

Sun et al. (Apr. 24, 1998) "The Structure of Glutamine-Binding Protein Complexed With Glutamine at 1.94 A Resolution: Comparisons with other Amino Acid Binding Proteins", Journal of Molecular Biology, 278(1):219-229.

Tian et al. (Oct. 1, 2003) "How Well is Enzyme Function Conserved as a Function of Pairwise Sequence Identity?", Journal of Molecular Biology, 333(4):863-882.

Todd (Apr. 1, 2001) "Evolution of Function in Protein Superfamilies, from a Structural Perspective", Journal of Molecular Biology, 307(4):1113-1143.

Vodnik et al. (May 15, 2012) "HWGMWSY, An Unanticipated Polystyrene Binding Peptide from Random Phage Display Libraries", Analytical Biochemistry, 424(2):83-86.

Vyas et al. (Apr. 26, 1994) "Crystallographic Analysis of the Epimeric and Anomeric Specificity of the Periplasmic Transport/Chemosensory Protein Receptor for D-Glucose and D-Galactose", Biochemistry, 33(16):4762-4768.

Vyas et al. (Dec. 2, 1988) "Sugar and Signal-Transducer Binding Sites of the *Escherichia coli* Galactose Chemoreceptor Protein", Science, 242(4883):1290-1295.

Weidemaier et al. (Jun. 15, 2011) "Multi-Day Pre-Clinical Demonstration of Glucose/Galactose Binding Protein-Based Fiber Optic Sensor", Biosensors and Bioelectronics, 26(10):4117-4123.

Weiner et al. (1971) "A Binding Protein for L-Glutamine and its Relation to Active Transport in *E. coli*", Archives of Biochemistry and Biophysics, 124:715-717.

Wilkins et al. (Jun. 1996) "Glucose Monitoring: State of Art and Future Possibilities", Medical Engineering & Physics, 18:273-288.

Willis et al. (Apr. 10, 1975) "Purification and Properties of a Periplasmic Glutamate-Aspartate Binding Protein from Escherichkz coli K12 Strain W3092", The Journal of Biological Chemistry, 250(7):2574-2580.

Willis et al. (Nov. 10, 1974) "Purification and Properties of a Ribose-binding Protein from *Escherichia coli*", Journal of Biological Chemistry, 249(21):6926-6929.

(56) References Cited

OTHER PUBLICATIONS

Willner et al. (Oct. 23, 1996) "Electrical Wiring of Glucose Oxidase by Reconstitution of FAD-Modified Monolayers Assembled onto Au-Electrodes", Journal of the American Chemical Society, 118(42):10321-10322.
Eitinger et al. (Jan. 2011) "Canonical and ECF-type ATP-Binding Cassette Importers in Prokaryotes: Diversity in Modular Organization and Cellular Functions", FEMS Microbiology Reviews, 35(1):3-67.
Siewe et al. (May 1998) "Urea Uptake and Urease Activity in Corynebacterium Glutamicum", Archives of Microbiology, 169(5):411-416.
Wood, David W. (Jun. 2014) "New Trends and Affinity Tag Designs for Recombinant Protein Purification", Current Opinion in Structural Biology, 26:54-61.
Yamaguchi et al. (Aug. 1999) "Characterization of Metal-Substituted Klebsiella Aerogenes Urease", Journal of Biological Inorganic Chemistry, 4(4):468-477.
Akiyama, N., et al., "Crystal Structure of a Periplasmic Substrate-Binding Protein in Complex with Calcium Lactate," Journal of Molecular Biology 2009, vol. 392, No. 3, pp. 559-565.
Archana, S., et al., "BIOT 348-Optical sensing of lactate using a fluorescently labeled lactate binding protein," Abstracts of Papers American Chemical Society, 2009, vol. 238, pp. 348-BIOT, 238th American-Chemical-Society National Meeting; Washington, DC, USA; Aug. 16-20, 2009.
D'Auria, S., et al., "A protein biosensor for lactate," Analytical Biochemistry 2000, vol. 283, pp. 83-88.

Database Genbank May 19, 2013 (May 19, 2013), "ABC transporter substrate-binding protein [*Thermus* sp. CCB_US 3 UF1]."
Database UniProt [Online] May 1, 2013 (May 1, 2013), "SubName: Full=2,3-diketo-L-gulonate-binding periplasmic protein yiaO {ECO:00003131EMBL:AFP29273.1};", XP002795971, retrieved from EBI accession No. UNIPROT:M1 FFZ1Database accession No. M1 FFZ1.
Database UNIPROTKB/TREMBL Jan. 7, 2015 (Jan. 7, 2015).
De Lorimier, R., et al., "Binding and signaling of surface-immobilized reagentless fluorescent biosensors derived from periplasmic binding proteins," Protein Science, 2006, vol. 15, No. 8, pp. 1936-1944.
European Patent Office, Extended European Search Report for Application No. 16867309.3, dated Sep. 9, 2019, 15 pages.
European Patent Office, Extended European Search Report for Application No. 16867310.1, dated Dec. 6, 2019, 20 pages.
European Patent Office, Extended European Search Report for Application No. 16867311.9, dated Sep. 10, 2019, 15 pages.
Hibbs, R., et al., "Acrylodan-conjugated cysteine side chains reveal conformational state and ligand site locations of the acetylcholine-binding protein," The Journal of Biological Chemistry 2004, vol. 279, pp. 28483-28491.
International Search Report and Written Opinion for International Application No. PCT/US2016/062960, dated May 22, 2017, 12 pages.
Tam, R., et al., "Structural, functional, and evolutionary relationships among extracellular solute-binding receptors of bacteria," Microbiological Reviewes, 1993, vol. 57, No. 2, pp. 320-346.

\* cited by examiner

FIG. 6

```
                                                                                                                                                  csUBP7
                                                                                                                                                  dcUBP4
                                                                                                                                                  ctUBP6
                                                                                                                                                  gtUBP5
                                                                                                                                                  gkUBP10
                                                                                                                                                  psUBP11
                                                                                                                                                  bsUBP3
                                                                                                                                                  teUBP12
                                                                                                                                                  taUBP8
                                                                                                                                                  mpUBP1
                                                                                                                                                  mhUBP2

β₁                                        α₁                                              β₂                    α₂
                         ----                               ================                                       ----              ==========
...SSSESRKEKSEETIKVGILHSLSGTMSISEVSLKDAELMAIEEINNNGGVLGKKLEPIVEDGASDWPTFAEKAKKLLQKDKV  csUBP7
...SSSESRKEKSEETIKVGILHSLSGTMAISEVSLKDAELMAIEEINASGLLGKKIEPVIEDGASDWPTFAEKAKKLLQQDKV  dcUBP4
...SAVDQARKNENRKEDSSASKEGDTIKVGILHSLSGTMAISEVSLKDAELMAIEEINQAGGLLGKKIEPVIEDGASDWPTFAEKAKKLLQNDKV  ctUBP6
...AASSAVDEVKEKKPKETSASETGDTVKVGILHSLSGTMAISEVSLRDAELMAIEEINKSGGLLGKKIEPVIEDGASDWPTFAEKAKKLLQKDKV  gtUBP5
...SSASKEGDTVKVGILHSLSGTMAISEVSLRDAELMAIEEINASGLLGKKIEPVIEDGASDWPTFAEKAKKLLQKDQV  gkUBP10
...SSPPVELAGDSIKVGILHSLSGTMAISEVSLKDAEMLAIEEINAAGGVLGKQIEPVIEDGASDWPTFAEKAGKLLQQDKV  psUBP11
...SSRASSALETDIDTSGDSVKVGILHSLSGTMAISEVSVHDAELLAIQEINQEAGGVTLGKQIEPLIEDGASDWPTYAEKMRKLLQQDKV  bsUBP3
...SSPKKIKVGILHSLSGTMAISEKSVVDATQLAIEQINQAGGVLGKQIQPILEDGASDPATFAQKAQKLILMDKV  teUBP12
...SAVITLETIAPALVWESPKKIKVGILHSLSGTMAISEVHVKNATLLAIEEVHVKGVLGYTIEPIIEDGASDPATFAQKAQKLILMDKV  taUBP8
...MKTILASAIALSGVTIAPFSGAVDIFKVGILHSLSGTMAISETTLKDTVLMVEEQNKKGSLLGKKLEAVVVDPASNWPLFAEKARELLTEDQV  mpUBP1
...MKDILSNLAKVSLANSVAARADIEKVGILHSLSGTMAISETALKDTMLMLIEKQNEAGGVLGRQLEPVVVDPASNWPLFAEKARELLEKEKV  mhUBP2
                   10              20               30              40              50              60              70              80

β₃              α₃                             β₄                     β₅                     β₆            α₄                       α₅                                β₇              α₆
          ---    =================                      ----                   ----                   ----       ==============              ============                      ----       ===========
MRESGYANHRDFIKASANVITLETIAPALVWP AVIFGCWTSASRKAVLPVVEENNGLLFYPVQEGLESSPNIFYMGAAPNQQIVPAVKWLFDNG-KKRFYLLGSDYVFPRTANKIIKAYLKY-LGG--EYTPLGHTDYSSVINK  csUBP7
                                 AVIFGGWTSASRKAVLPVVEENNGLLFYPVQEGLESSPNIFYTGAEPSQQIVPAVSWLLENR-GKKFYLLGSDYVFPRTANKIIKAQLKA-KGG--EVVGE--EYTPLGHTDYSTIINK  dcUBP4
                                 ATVFGCWTSASRKAVLPVFEENNGLLFYPVQEGMESSPNIFYTGAAPNQQIVPAVEWLLENR-GKRFYLLGSDYVFPRTANKIIKAQLKA-IGG--ELIAE--EYTPLGHTDYSTIVNK  ctUBP6
                                 AAIFGGWTSASRKAMLPVVEQNNGLLWYPVQEGMESSPNIFYTGATTNQQIVPAVSWLLENR-GKRFFLLGSDYVFPRTANKIIKAQLKA-EGG--QLVGE--EYTPLGHTDYSTIINK  gtUBP5
                                 AAVFGGWTSASRKAMLPVFEQNHGLLFYPVQEGLESSPNIFYTGATTNQQIVPAVSWLLENR-GKTFFLLGSDYVFPRTANKIIKAQLKA-EGG--QVVGE--EYTPLGHTDFSTIISK  gkUBP10
                                 AAVFGGWTSASRKAMLPVFEQNHGLLFYPVQEGMETSPNIFYTGATTNQQIVPSVSWLLENR-GKKMFLLGSDYVFPRTANKIIKAQLTA-EGG--ELAGE--EYTPLGHTDFSTIIAK  psUBP11
                                 VAVFGGWTSASRKAMLPVFESKNHMLWYPVQEGQECSKNIFYTGAQNECSPNIFYTGAAPDWLLQNK-GKKFFLIGSDYVFPRTANKIIKAQLTA-GGG--EIAGE--EYTPLGHTNYSTLVSK  bsUBP3
                                 VTVFGGWTSVSRKSVLPVFERYKNLLWYPVQEFEGNECSPNIFYTGAQPNQQILPALEWALKQG-YKKFFLVGSDYVFPRTANLLLEKHIQK-NGA--ETVGE--DYLPLGNTEVTPIITR  teUBP12
                                 VTVFGGWTSVSRKSVLPVFERYKNLLWYPVQEFEGNECSPNIFYTGAQPNQQIPAVNYLKDELGVERWVLAGTDYVYPRTTNKILEAYLRD-MGV--IVSGE--EYVPLGGTDFSAVVNK  taUBP8
                                 DVIFGMWTSVSRKSVLPVIEELNGIMFYPVQEGEESSYNVFYTGAAPNQQAIPAVNYLKDELGVERWVLAGTDYVYPRTTNKILEAYLRD-MGV--AEDDIMINYTPFGHSDWQSIVSD  mpUBP1
                                 DVIFGNWTSVSRKSVLPVVEELNGLLFYPVQEEESSENVFYTGAAPNQQAIPAVDYLMNDLGVERWVLAGTDYVYPRTTNKILETYLK-DKGVAAGDIMI--NYTPFGHSDWQTIVSD  mhUBP2
     90              100              110              120              130              140              150              160              170              180              190
```

MRKSMKMLIRKMLSLLLVTVMVAVLIYGCKKSSSSSESEKEKSEETIKVGILHSLSGTMSISEVSLKDAELMAIEEINNNGVLGEKKLEPIVEDGASDWPTFAEKAKKLLQKDKVAVIFGC csUBP7
                                                                                                                      |  ||||||
                              PLIGLLESEIGVTADIERSQRYGALIAVEDLMREGSVGGRPIETLSQDPGGDPDRYRLCAEDFIRNGVRPLVGC paAmiC
         10        20        30        40        50        60        70        80

KTSASRKAVLPVVEENNGLLFYPMQEGLESSPNIFYMGAAPMQDYPAVKMLFDN-GKKEFYLLGSDYVFPRTANKLIKYLK-YLGGVVGEEYTPLGHTD--YSSVDNKIKAAKP-- csUBP7
  ||||
YMSHTRKAVMPVVERADALLCYPTPYEGFEYSPNIVYGGPAPMQNSAPLAAYLIRHYG-ERMVFIGSDYIYPRESMRVMRHLYRQHGGTVLEEI-YIPLYPSDDDLQRAVERIYQAR--A paAmiC
         90       100       110       120       130       140       150       160       170       180       190

DVVFNTLMGDSMVAFFKQLKDAGIDANTL------PMSVSIAEERIKGIGPRYLKGHLVYMNYFQSVDTFEMKEZVEKYKKKYGEDRVFDDPIBAAYIGVYLWAKAVEREAG-STDVDKVR csUBP7
  ||||
DVVFSTVVGTGTAELYRALARRYG------DGRRPPIASLTTSEAEVAKRMFSDVAEEQVVVAPYFSSIDTPASRAPVQACHGFFPENATITFAWAKAEAATMQTLLLGRAADAAGWRFVFDVQR paAmiC
        210       220       230       240       250       260       270       280       290       300       310

EAAK-GIEFNAPEGFVKIDED-MGHLYKTVRIGEILENGQIRELWKTNKFVKPFYLKGFEWADQZLSEQ csUBP7

HLYDIDID-APQGPVRVERQWMHSRLSSRIAEIDARGVFQVRWQSPEPIREDPYVVFRNLDPW paAmiC
        320       330       340       350       360       370

FIG. 9

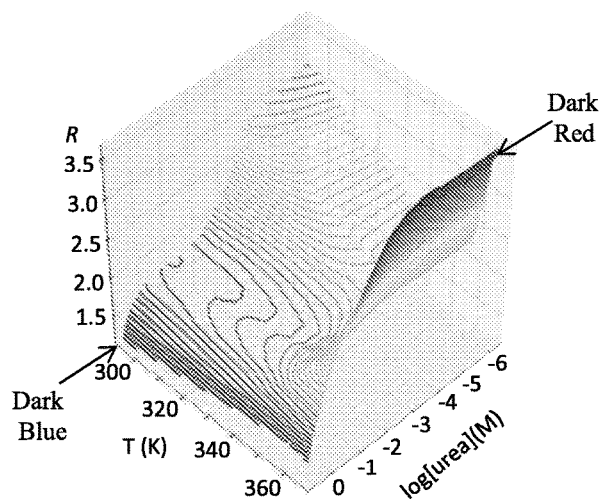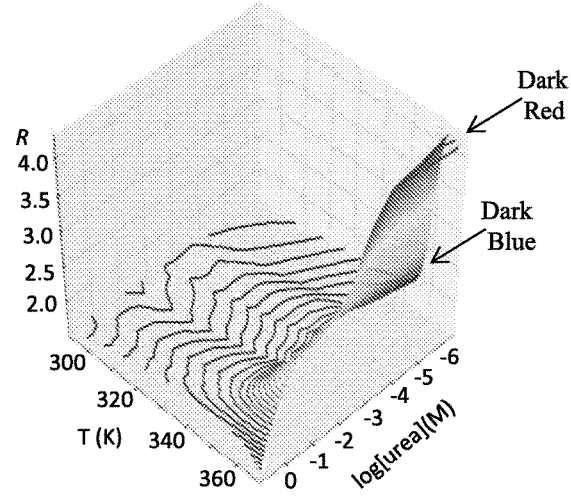
FIG. 10C  FIG. 10F

FIG. 12G
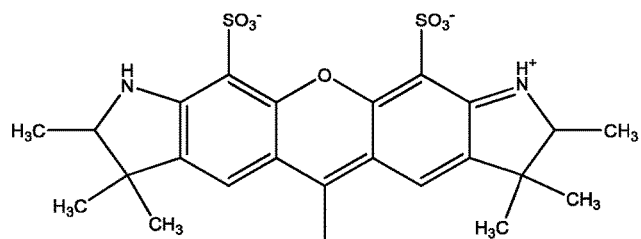
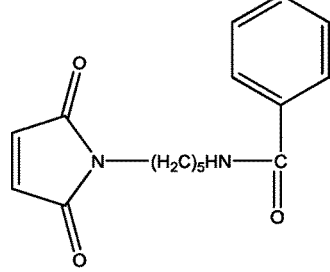
FIG. 12H
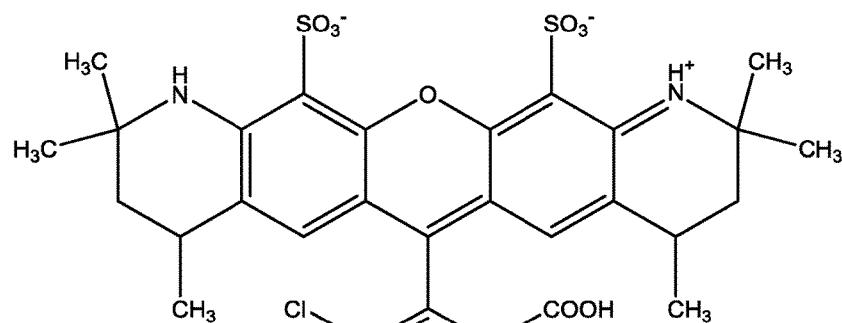
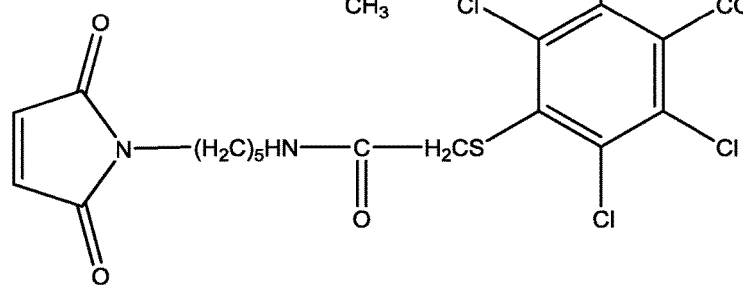
FIG. 12I
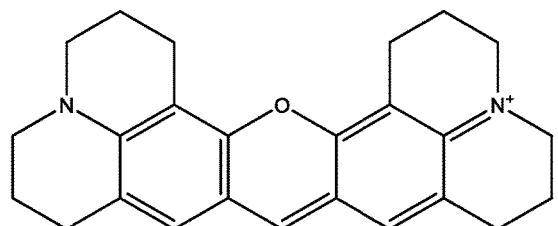
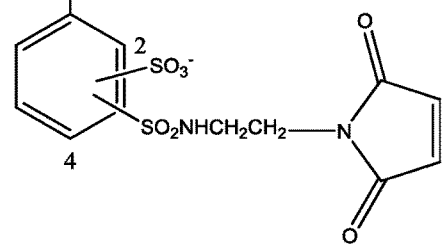

FIG. 17 - Exemplary Expression Construct for mpUBP1

```
GCCAGTAAGCTTCGTCACGCTTGGGACTGCCATAGGCTGCGACCCGGTGATGCCGGCCGACGATGCGTCCGGCCGTAGAGGATCGAGATCTCGATCCCCGAAATAATACGACTCACTATAG
CGGTCATTCGAAGCCAGTGCGACCCTGACGGTACTCGACCGGTGCTACGGCCACTACGACGGTGCTATCCGACGGCGGCATCCGGCATCTCCTAGAGCTCTAGAGCTTTAATTATGCTGAGTGATATC
         10         20         30         40         50         60         70         80         90        100        110        120
                                                                                                      M  K  V  G  V  L  H  S  L  S  G  T  M  A  I  S  E  T  T  L
GGAGACCAACAACGGTTCCCCTCTAGAATAATTTGTTTAACTTAAGAAGGAGATATACCATGAAAGTAGGTGTATTACATTCATTATCAGGTACTATGGCCATTTCCGAAACAACGCT
CCTCTGGTTGTTGCCAAGGGAGATCTTATTAAACAAATTGAAATTCTTCCTCTATATGGTACTTTCATCCACATAATGTAAGTAATAGTCCATGATACCGGTAAAGGCTTTGTTGCGA
        130        140        150        160        170        180        190        200        210        220        230        240
                          30                              40                              50
 K  D  T  V  L  M  M  V  E  Q  N  K  K  G  G  L  L  G  K  K  L  E  A  V  V  V  D  P  A  S  N  W  P  L  F  A  E  K  A
GAAAGATACCGTATTAATGATGGTCGAGGAGCAAATAAGAAGGGGGCCTCTGGCAAGAAGTTGGAAGCTGTAGTCGTCGACCCGGCATCAAATTGGCCACTCTTTGCCGAAAAAGC
CTTTCTATGGCATAATTACTACCAGCTCCGTCGTTTATTCTTCCCCCGGAGACCGTTCTTCAACCTTCGACATCAGCAGCTGGGCCGTAGTTTAACCGGTGAGAAACGGCTTTTTCG
        250        260        270        280        290        300        310        320        330        340        350        360
                              70                              80                              90
 R  E  L  L  T  E  D  Q  V  D  V  I  F  G  A  W  T  S  V  S  R  K  S  V  L  P  V  I  E  E  L  N  G  L  M  F  Y  P  V  Q
ACGTGAACTGTTGACAGAAGACCAAGTGGACGTAATTTTCGGGGCCTGGACATCTGTCAGCCCGAAATCAGTACTCCCGGTGATTGAGGAATTAAATGGTCTTATGTTTTATCCGGTCCA
TGCACTTGACAACTGTCTTCTGGTTCACCTGCATTAAAGCCCCGGACCTGTAGACAGTCGGGCCTTAGTCATGAGGGCCACTAACTCCTTAATTTACCAGAATACAAAATAGGCCAGGT
        370        380        390        400        410        420        430        440        450        460        470        480
                        110                             120                             130
 Y  E  G  E  E  S  S  Y  N  V  F  Y  T  G  A  A  P  N  Q  Q  A  I  P  A  V  N  Y  L  K  D  E  L  G  V  E  R  W  V  L  A
ATACGAGGGGGAAGAGTCGTCTATAACGTATTTTATACCGGGGCAGCCCCGAATCAACAGGCTATCCCTGCCGTCAACTACCTGGAACGAATTGGGTGTCAACGTTGGTCTCTCGC
TATGCTCCCCCTTCTCAGCAGATATTGCATAAAATATGGCCCCGTCGGGGCTTAGTTGTCCGATAGGGACGGCAGTTGATGGACTTGCTTAACCCACAGTTGCAACCCAGGAGCG
        490        500        510        520        530        540        550        560        570        580        590        600
                        150                             160                             170
 G  T  D  Y  V  P  R  T  T  N  K  I  L  E  A  Y  L  K  D  M  G  V  A  E  D  D  I  M  I  N  Y  T  P  F  G  H  S  D  W
CGGGACAGAGACTATGTCTATCCACGGACTACGAATAAGATTCTCGAAGCGTACCTCAAGGATATGGGCGTCGCGGAAGATGATATTATGATTAATTACACACCATTCGGCCACTCCGATTG
GCCCTGTCTCTGATACAGATAGGTGCCTGATGCTTATTCTAAGAGCTTCGCATGGAGTTCGTACCGCAGCGCCTTCAGCTCCTATACCGGTAAGCCGGTGAGGCCTAAC
        610        620        630        640        650        660        670        680        690        700        710        720
                        190                             200                             210
 Q  S  I  V  S  D  I  K  K  F  G  S  A  G  K  K  T  A  V  V  S  T  I  N  G  D  A  N  V  P  F  Y  K  E  L  G  N  Q  G  I
CAAAGTATTGTCTCAGATATCAAAAAGTTCGGCTCCGCAGGAAGAAGACTGCAGTAGTATCCACCATTAACGGTGACGCTAATGTGCCATTTTACAAGGAGTTAGGTAACCAGGGCAT
GTTTCATAATAACAGAGTCTATAGTTTTTCAAGCCGAGGCGTCCTTCTTCTGACGTCATCATAGGTGGTAATTGCCACTGCGATTACACGGTAAAATGTTCCTCAATCCATTGGTCCCGTA
        730        740        750        760        770        780        790        800        810        820        830        840
                        230                             240                             250
 S  S  E  D  I  P  V  V  A  F  S  V  G  E  E  E  L  S  G  L  D  T  A  P  L  V  G  H  L  A  A  W  N  Y  F  Q  S  V  E  T
TTCGTCAGGAGGACAATTCCAGTGGTCGCCTTCAGCGTCGGTGGTGAGGAGGAGCTCTCAGGCCTTGATACCGCACCACTGGTTGGCCATCTGGCTGCGTGGAATTACTTCCAATCTGTAGAGAC
AAGCAGTCTCCTGTTAAGGTCACCAGCGGAAGTCGCAGCCACCAGCACTCCAGAGTCCGGAACTATGGCGTGGTGACCAACCGGTAGACCGTAAGAATCCAGAGTTAGACATCTCTG
        850        860        870        880        890        900        910        920        930        940        950        960
                        270                             280                             290
```

```
  D   E   N   E   E   F   I   T   K   W   Q   A   Y   T   K   N   P   E   R   V   T   N   D   P   M   E   A   T   F   F   I   G   F   N   M   W   A   N   A   V   T
TGACGAGAACGAGGAGTTCATTACAAAGTGGCAAGCTATACAAAAAATCCTGAACGCGTCACAAATGAACCTTCATCGGCTTTAATATGTGGGCAAACGCAGTAAC
ACTGCTCTTGCCTCCTCAAGTAATGTTTCACCGTTCGCCAGATATGTTTTTAGGACTTGCGCCAGTGTTTACTTCGTTGAAGTAGCCGAAATATACACCCGTTGCGTCATTG
          970         980         990        1000        1010        1020        1030        1040        1050        1060        1070        1080
                                                                                  320                                        330
  E   A   G   T   T   D   V   D   A   V   E   K   A   M   I   G   Q   E   T   P   N   L   T   G   G   I   A   V   M   N   K   N   H   H   L   S   K   P   V   L
AGAAGCGGGTACCACAGATGTAGATGCCGTCGAGAATGCCTATGATTGGGCAGGAGACACCAAATCTGACAGGTGGCATTGCAGTAATGAACAAGAACCACTTGAGTAAACCAGTCCT
TCTTCGCCCATGGTGTCTACATCTACGGCAGCTCTTCCGATACTAACCCGTCCTCTGTGGTTTAGACTGTCCACCGTAACGTCATTACTTGTTCTTGGTGAACTCATTTGGTCAGGA
         1090        1100        1110        1120        1130        1140        1150        1160        1170        1180        1190        1200
                310                                        350                                        360
  I   G   E   I   Q   D   D   G   Q   F   E   T   V   W   E   T   D   G   V   V   P   G   D   A   W   S   D   F   L   P   G   S   K   D   L   V   A   D   W   T
TATCGGTGAAATCCAGGATGACGGGCAGTTCGAGACAGTGTGGGAAACAGATGGTGTGGTCCCAGGGGATGCATGGTCCGACTTCTTGCCAGGCTCAAAAGATCTTGTCGCCGATTGGAC
ATAGCCACTTTAGGTCCTACTGCCCGTCAAGCTCTGTCACACCTTTGTCTACCACAGGGTCCCCTACGTACCAGGCTGAAGAACGTCCGAGTTTCTAGAACAGCCGCTAACCTG
         1210        1220        1230        1240        1250        1260        1270        1280        1290        1300        1310        1320
                                                                390                                        400                                        410
  D   P   L   K   A   G   N   Y   N   T   E   T   K   M   A   S   G   Q   N   Y   G   G   S   H   H   H   H   H   H   *   *
GGATCCATTGAAGGCCGGGAACTACAATACGGAAACCAAGATGGCATCAGGTCAGAATTATGGCGGTAGTCATCATCATCATCATTAATGAAAGGGCGATATCCAGCACTGGCGG
CCTAGGTAACTTCCGGCCCTTGATGTTATGCCTTTGGTTCTACGTAGTCCAGTCTTAATACCGCCATCAGTAGTAGTAGTAGTAGTAATTACTTTCCGCTATAGTCGTGACCGCC
         1330        1340        1350        1360        1370        1380        1390        1400        1410        1420        1430        1440
CCGTTACTAGTGGATCCGGCTGCTAACAAAGCCCGAAAGGAAGCTGAGTTGGCTGCTGCCACCGCTGAGCAATAACTAGCATAACCCCTTGGGCCTCTAAACGGGTCTTGAGGGTTT
GGCAATGATCACCTAGGCCGACGATTGTTTCGGGCTTTCCTTCGACTCAACGACGGTGCCGACTCGTTATTGATCGTATTGGGAACCCCGGAGATTTGCCCAGAACTCCCAAA
         1450        1460        1470        1480        1490        1500        1510        1520        1530        1540        1550        1560
TTGCTGAAAGGAGGAACTATATCCGGAGCGACTCCCACGGCACGTTGGCAAGCTCGAATTCGGCGTAATC
AACGACTTTCCTCCTTGATATAGGCCTCGCTGAGGGTGCCGTGCAACCGTTCGAGCCTTAAGCCGCATTAG
         1570        1580        1590        1600        1610        1620        1630

FIG. 17 (Continued)
```

FIG. 18 - Exemplary Expression Construct for mhUBP2

```
         D   A   N   Y   D   F   I   D   A   W   V   A   Y   K   G   D   D   A   A   V   T   N   D   P   M   E   A   H   Y   I   G   F   N   M   Y   V   E   A   V   K
     CGATGCCAACTACGACGATTTTATTGATGATGGTCGCTTACAAAGGGACGACGCCCGTCACGAATGACCCAATGGAAGCAACACTATATCGGGTTTAACATGTACGTGGAAGCCGTAAA
        970       980       990      1000      1010      1020      1030      1040      1050      1060      1070      1080
     GCTACGGTTGATGCTAAAATAACTACGTACCCAGCGAATGTTTCCCGTGCTGCGGCGCAGTGCTTACTGGGTTACCTTCGTGTGATATAGCCCAAATTGTACATGCACCTTCGGCATTT
         K   A   G   T   T   D   V   D   E   V   K   D   A   I   I   G   V   S   V   P   N   L   T   G   G   Y   A   T   M   M   P   N   H   H   I   T   K   P   V   L
     GAAAGCGGGTACAACGACGAGTGGATGAGGTCAAAGACGCAATCATCGGTGTATCAGTTCCTAACTTAACCGGCGGCTACGCAACCATGATGCCTAACCACCATATACCAAGCCAGTATT
       1090      1100      1110      1120      1130      1140      1150      1160      1170      1180      1190      1200
     CTTTCGCCCATGTTGCTGCTCACTCACTCCAGTTCTGCGTTAGTAGCCACATAGTCAAGGATTGAATTGGCCGCCGATGCGTTGGTACTACGGATTGGTGGTATAGTGGTTCGGTCATAA
         I   G   E   I   Q   D   N   G   Q   F   S   V   V   W   E   T   P   S   T   V   A   G   D   A   W   S   D   F   L   P   G   S   K   D   L   I   S   D   W   R
     AATCGGTGAGATCCAAGACAATGGTCAGTTCAGCGTGGTCTGGGAGACACCGTCAACAGTCGCACAGTCGACGCATGGTCAGATTTCCTTCCTGCTAGTAGTAAAGATTTAATTTCAGATTGGCG
       1210      1220      1230      1240      1250      1260      1270      1280      1290      1300      1310      1320
     TTAGCCACTCTAGGTTCTGTACCAGTCAAGTCGCACCAGAGCCCTGTGGCAGTTGCAGCGTCCACTGCGTCTAAAGGAAGGACCATCATTCTAAATTAAAGTCTAACCGC
         A   P   L   R   A   G   N   F   N   V   V   T   G   K   A   G   G   G   S   A   D   V   A   S   N   G   G   S   H   H   H   H   H   H   *
     TGCCACCACTCCGTGCCGGGAATTCAATGTCGTGACAGGCAGTCGCAGAAGCCAGGCAGTGCAGATCGGTTCACATCATCAAATGGCGGTTCACATCATCATCATCATTAATGAAAGGGCCGATAT
       1330      1340      1350      1360      1370      1380      1390      1400      1410      1420      1430      1440
     ACGTGGTGAGGCACGCCCTTAAAGTTACAGCACACTGTCCGTTCGTCACTGCTAGTCATCGTAGTTTACCGCCAAGTGTAGTAGTAGTAGTAGTAATTACTTCCCGCTATA
     CCAGCACACTGCGGCCGTTACTAGTGGATCCGCTGCTAACAAAGCCCGAAAGGAAGCTGAGTTGGCTGCTGCCGACCGAGCAATAACTAGCATAACCCCTTGGGCCTCTAAACGG
       1450      1460      1470      1480      1490      1500      1510      1520      1530      1540      1550      1560
     GGTCGTGTGACCGCCGGCCAATGATCACCTAGGCCGACGATTGTTTCGGGCTTTCGACTCAACCGACGACTCGTCGTTATTGATCGTATTGGGAACCCCGGAGATTTGCC

GTCTTGAGGGGTTTTTGCTGAAAGGAGGAACTATATCCGGAGCGACTCCCACGCGACGTTGGCAAGCTCGGAATTCGGCGTAATC
       1570      1580      1590      1600      1610      1620      1630      1640
     CAGAACTCCCCAAAAAACGACTTTCCTCCTTGATATAGGCCTGCCGTGCAACCGTTCGAGCCTTAAGCCGCATTAG

FIG. 18 (Continued)
```

FIG. 19 – Exemplary Expression Construct for bsUBP3

```
GCCAGTAAGCTTCGGTACGCTTGGGACTTGCCATAGCCTGGCCCGGTGATGCCGGCCGTAGAGAATCGAGATCTCGATCCGCGAAATTAATACGACTCACTATAG
         10        20        30        40        50        60        70        80        90       100       110       120
CGGTCATTCGAAGCCAGTGCGAACCCTGACGGCCACGGGCCACTACGGCCGTGCTACGCAGGCCATCCTAGTCTTAGAGCTAGGGCGCTTAATTATGCTGAGTGATATC

GGAGACCACAACGGTTCTCCCTCTAGAAATAATTTTGTTAACTTTAAGAAGGAGATATACCATGAAAGTAGGCATTTTGCATTCTTTATCAGGTACCATGGCAATCTCGAAGTAAGTGT
                                                             M   K   V   G   I   L   H   S   L   S   G   T   M   A   I   S   E   V   S   V
                                                                                                            10
        130       140       150       160       170       180       190       200       210       220       230       240
CCTCTGGTGTTGCCAAAGGAGAATCTTATTAAACAATTGAAATTCTTCCTCATATGTACTTTCATCCGTAAACGTAAGAAATAGTCCATGGTACCGTTAGAGCCTTCATTCACA

TCACGACGCCGAGCTCATTGCGAATCAAGAAATCAATCAGAAGGAGTCTTCGGTGTCCTCGGTAAGAACTCGAACCCGTAGTGGAAGATGTGCATCCGACTGGCCATACATGCAGAGAAAT
 H   D   A   E   L   I   A   I   Q   E   I   N   Q   K   G   G   V   L   G   K   K   L   E   P   V   V   E   D   G   A   S   D   W   P   T   Y   A   E   K   M
              30                              40                              50                              60
        250       260       270       280       290       300       310       320       330       340       350       360
AGTGCTGCGGCTCGAGTAACGCTAGGTTCTTCCCCCACAGAGCCATTCTTTAGTTCTTGAGCTTGGCCATCACCGTAGGCTGACCGGATGTATACGTCTCTTTA

CGCGAAGCTCTTACAGCAGGATAAAGTAGCCAGTATTCGGCCGGCGGTGGACCTCCGTAGTGCAGTAGCCAATGCTTCCAGTAGTCGAGCAGTCGAACAAATAACGGCTCTTATTTACCCAGTCCA
 R   K   L   L   Q   Q   D   K   V   A   A   V   F   G   G   W   T   S   A   S   R   K   A   M   L   P   V   V   E   Q   N   N   G   L   L   F   Y   P   V   Q
              70                              80                              90
        370       380       390       400       410       420       430       440       450       460       470       480
CGCCTTCGAGAATGTCGTCCTATTTCATCGTCGTCGAGCCGCCATTCCGTTACGAAGGTCATCAGCTCGTTGTTAGCAGGGTCGGCATCTAACCGAAAACTTCTTATTCCCTTTTTAAGAAGGAGTAGCC

GTACGAAGGGATGGAGACATCGGCAAATCTTCTATACTGGTGCAACAACAACAAATCGTCCCAGCCGTAGATTGGCTTTGAAGAATAAAGGAAAAATTCTTCCTCATCGG
 Y   E   G   M   E   T   S   P   N   I   F   Y   T   G   A   T   T   N   Q   Q   I   V   P   A   V   D   W   L   L   K   N   K   G   K   K   F   F   L   I   G
             110                             120                             130
        490       500       510       520       530       540       550       560       570       580       590       600
CATGCTTCCCTACCTCTGTAGCGTTGTTGTTCGGTTGTTCTAATATGACCACGTTGTTTGTTGCAGGGTCGGCATCTAACCGAAAACTTCTTATTCCCTTTTTAAGAAGGAGTAGCC

TAGTGACTACGTCTTCCCGCGTACCGCCAACAAGATTATCAAAGCCCAGGTCAAAGCGGGGCGGCGAAATTGCGGGTGAGGAGTACACCCCATTGGGCCACCATTATTCAACACT
 S   D   Y   V   F   P   R   T   A   N   K   I   I   K   A   Q   V   K   A   G   G   G   E   I   A   G   E   E   Y   T   P   L   G   H   T   N   Y   S   T   L
             150                             160                             170
        610       620       630       640       650       660       670       680       690       700       710       720
ATCACTGATGCAGAAGGGCGCATGCGGTTGTTCTAATAGTTTCGAGTTCGCCAGTTTCGAGTTCGAGTTGCGAACCACTCCTCATGTGGGTAACCCGGTGTGATTAATAAGTTGTGA

GGTATCCAAAATCAAGGAAAAACAACCAGATGTAATCTTTAATACACTCAACGGGACTCTAACGTTGCCTTCTTTTAAGCAGCTCAAGGATGCAGGATCAGGAGGATCAGCGCTGACGATATGCCGGT
 V   S   K   I   K   E   K   Q   P   D   V   I   F   N   T   L   N   G   D   S   N   V   A   F   F   K   Q   L   K   D   A   G   I   S   A   D   D   M   P   V
             190                             200                             210
        730       740       750       760       770       780       790       800       810       820       830       840
CCATAGTTTTAGTTCCTTTTGTTGGTCTACATTGAGAAATTATGTGAGTTGCCCTGAGTTCGAACGAAGAAATTCGTCGAGTTCCTACGTCCCTAGTCGCGACTGCTATACGGCCA

AATGAGCGCATCTGTCGCCGAGGAGGAGATCCGGGGATTGGGCCAGACGTACTCAAGGGGCATTATGCCGTGTGGAACTACTTTCAAACTACTAACACCAGTGAGAACCAAACATTCGT
 M   S   A   S   V   A   E   E   E   I   R   G   I   G   P   D   V   L   K   G   H   Y   A   V   W   N   Y   F   Q   T   T   N   T   S   E   N   Q   T   F   V
             230                             240                             250
        850       860       870       880       890       900       910       920       930       940       950       960
TTACTCGGCTAGACAGCGGCTCCTCCTAGGCCCCTAACCGTCCCATGAGTTCCCGTAATACGGCACCCTTGATGATTGATGAAAGTTTGATGATTGTGGTCACTCTTGGTTTGTAAGCA
```

```
        K  N  Y  K  K  M  N  G  D  S  R  V  T  S  D  P  I  E  A  G  Y  N  A  V  Y  L  W  A  A  A  V  E  K  A  K  S  F  D  V  D
CAAAATTATAAAAGATAACGGTGACAGCCGGGTAACTAGCGATCCAATTGAGGCCGGGTATAACGCAGTCTATCTCTGGGCCGCAGTAGAAAAGCTAAGAGTTTGACGTGA
GTTTTAATATTTTCTACTTGCCACTGTCGGCGCATTGATCGCTAGGTTAACTCCGGCCCATATTGCGTCAGATAGAGACCCGGCCGGCGTCATCTTTTCGATTCTAAAACTGCACCT
   970       980       990       1000      1010      1020      1030      1040      1050      1060      1070      1080
                                                                290
        K  V  K  K  A  A  D  G  I  S  F  K  A  P  G  G  T  V  K  I  D  G  D  T  Q  H  L  Y  K  T  V  R  I  G  Q  I  T  G  D  G
CAAGGTCAAGAAAGCCGCAGATGGTATTAGTTTCAAGGCCCCAGGTGGCACCGTAAAGATCGATGGTGATACTCAGCACTTATATAAGACCGTACGCATCGGGCAGATTACGGGGATGG
GTTCCAGTTCTTTCGGCGTCTACCATAATCAAAGTTCCGGGGTCCACCGTGGCATTTCTAGCTACCACTATGAGTCGTGAATATATTCTGGCATGCGTAGCCCGTCTAATGCCCCTACC
   1090      1100      1110      1120      1130      1140      1150      1160      1170      1180      1190      1200
                                                                              370
        Q  F  K  E  V  W  N  S  G  E  P  V  K  P  D  P  Y  L  K  T  Y  D  W  A  K  G  L  S  K  G  G  S  H  H  H  H  H  H  *  *
TCAGTTCAAAGAGGTATGGAATAGTGGTGAACCAGTGAAGCCAGATCCGTATTTGAAGACCTATGATTGGGCAAAGGGCCTCTCCAAAGGTGGTTCACATCATCATCATCATCATTAATG
AGTCAAGTTCTCCATACTTATCACCACTTGGTCACTTCGGTCTAGCCATAAACTTCTGGATACTAACCCGTTTCCACCAAGTGTAGTAGTAGTAGTAGTAGTAATTAC
   1210      1220      1230      1240      1250      1260      1270      1280      1290      1300      1310      1320

AAAGGGGCGATATCCAGTCAGCCACACTGGGCGGCCGTTACTAGTGGAATCCGGCGCTGCTAACAAAGCCCGAAAAGGAAGCTGAGTTGGCTGCTGCCACCGCTGAGCAATAACTAGCATAACCCCTTGGG
TTTCCCGCTATAGGTCGTGTGACCGCCGGCAATGATCACCTAGGCCGACGATTGTTTCCTTCGACTCAACGACGACGGTGGCGACTCGTTATTGATCGTATTGGGAACCC
   1330      1340      1350      1360      1370      1380      1390      1400      1410      1420      1430      1440

GCCTCTAAACGGGTCTTGAGGGGTTTTTTGCTGAAAGGAGGAACTATATCCGGAGCGACTCCCACGGCACGTTGGCAAGCTCGGAAATTCGGCGTAATC
CGGAGATTTGCCCAGAACTTGCCCAAAAACGACTTTCCTTGATATAGGCCTCGCGTGAGGGTGCCGTGCAACCGTTGAGCCGTTCGAGCCTTAAGCCGCATTAG
   1450      1460      1470      1480      1490      1500      1510      1520      1530
```

FIG. 19 (Continued)

FIG. 20 - Exemplary Expression Construct for dcUBP4

```
              F  V  K  K  F  K  T  K  Y  G  Q  D  R  V  T  D  D  P  I  E  A  G  Y  F  G  V  V  Y  L  W  A  E  A  V  K  K  A  N  S  T  D
     GTTCGTGAAAAAGTTCAAGACAAAATACGGCCAAGATCGGGTAACTGGGTAACTGACGACCTATCGAAGCCGGCTATTTTGGCGTATATCTGTGGGCAGAAGCTGTGAAGAAAGCGAACTCAACGGA
     CAAGCACTTTTTCAAGTTCTGTTTTATGCCGGTTCTAGCGACTGCTGGATAGCTTCGGCCGATAAAACCGCATATAGACACCCGCTTCGACACTTCTTTCGCTTGAGTTGCCT
              970        980        990        1000       1010       1020       1030       1040       1050       1060       1070       1080
              V  G  K  V  K  E  A  I  K  T  V  E  F  Q  A  P  E  G  L  V  K  I  N  G  E  N  Q  H  T  W  K  T  V  R  I  G  E  V  Q  P
     CGTCGGTAAGGTAAAGGAAGCCATCAAGACAGTAGAGTTTCAAGCCCCGGAAGTTTAGTCAAAATCAACGGTGAGAACCAACACGTGAAAACAGTGCGGATCGGTGAAGTACAGCC
     GCAGCCATTCCATTTCCTTCGGTAGTTCTGTCATCTCAAAGTTCGGGCCTTCCAAATCAGTTTTAGTTGCCACTCTTGGTTGTGCACTTTGTCACGCCTAGCCACTTCATGTCGG
              1090       1100       1110       1120       1130       1140       1150       1160       1170       1180       1190       1200
              D  G  Q  F  K  E  L  W  N  S  G  G  P  V  K  P  D  D  P  Y  L  K  G  Y  E  W  A  K  G  L  S  N  G  G  S  H  H  H  H  H  H
     AGATGGTCAATTCAAAGAACTGTGGAACTCAGGGGTCCAGTCAAACCTGACCTCAAACCTGACCCCCATATTTAAAAGTTACGAGTGGGCCAAAAGGGCTCTCGAATGGCGGTAGTCATCATCATCATCA
     TCTACCAGTTAAGTTTCTTGACACTTGAGTCTCCCCCAGGTCAGTTTGGACTGGGTATAAATTTTCAATGCTCACCCGGTTTCCCGGAGACCTTACCGCCATCCAGTAGTAGTAGT
              1210       1220       1230       1240       1250       1260       1270       1280       1290       1300       1310       1320
     * *
     TTAATGAAAGGCGATATCCAGCAGTATCGGGCCGTTACTAGTGGATCCGGCTGCTAACAAAGCCCGAAAGGAAGCTGAGTTGGCTGCTGCCACCGCTGAGCAATAACTAGCATAACCC
     AATTACTTTCCGCTATAGGTCGTGTGACCGCCGCAATGATCACCTAGGCCGACGATTGTTTCGGGCTTTCCTTCGACTCAACGACGACGTTGCGACTCGTTATTGATCGTATTGGG
              1330       1340       1350       1360       1370       1380       1390       1400       1410       1420       1430       1440

CTTGGGGCCTCTAAACGGGTCTTGAGGGTTTTTTGCTGAAAGGAGAACTATATCCGGAGGCACTCCCACGGCACGTTGGCAAGCTCGGAATTCGGCGTAATC
     GAACCCCGGAGATTGCCCAGAACTCCCAAAAAACGACTTTCCTCCTTGATATAGGCCTCGCTGAGGGTGCCGTGCAACCGTTCGAGCCTTAAGCCGATTAG
              1450       1460       1470       1480       1490       1500       1510       1520       1530       1540
```

FIG. 20 (Continued)

FIG. 21 - Exemplary Expression Construct for gtUBP5

```
GCCAGTAAGCTTCGGTGCACGCTTGGGACTTGCCATAGCTGGCCGACCTGAGTGCCGCCCGGTGATGCCGCCCGGTAGAGGATCGAGATCTCGATCCCGCGGAAATTAATACGACTCACTATAG
CGGTCATTCGAAGCCAGTGCAGTGGGAACCCTGAACGGCGACCGGCCACTACGGCCGGGCACTACGCCGGTGCTACGCAGGCCATCTCCTAGCTCTAGAGCTAGGGCGCTTAATTATGCTGAGTGATATC
   10         20         30         40         50         60         70         80         90        100        110        120
                                                                                  M  A  S  S  A  V  D  E  V  K  E  K  P  K  E  T  S  A  S  E
                                                                                                      10
GGAGACCACAACGGTTTCCCTCTAGAAATAATTTGTTAACTTTAAGAAGGAGATATACCATGGCAAGTAGTGCAGTAGATGAAGTTAAAGAAAAGCCTAAAGAAACTAGTGCAAGCGA
CCTCTGGTGTTGCCAAAGGAGATCTTTATTAAACAATTGAAATTCTTCCTCATATGGTACCGTTCATCACGTCATCTACTTCAATTCTTTTCGGATTCTTTTGATCACGTTCGCT
  130        140        150        160        170        180        190        200        210        220        230        240
 T  G  D  T  V  K  V  G  I  L  H  S  L  S  G  T  M  A  I  S  E  V  S  L  R  D  A  E  L  M  A  I  E  E  I  N  K  S  G  G
             30                                40                                    50
GACCGGCGACACCCGTTAAGGTCGGCATCTTACACAGTCTTTCTCGGAGCTCCATTGGGACACTCATTCCGAGCTGAGCTCATGGCTGAGCTCATGGCAATTGAGGAGATCAATAAGTCAGGGGG
CTGGCCGCTGTGGCAATTCCAGCCGTAGAATGTGTCAGAAAGAGCCGTAGAAAGAGCCTCGAGTAAATGCCCTGCGACTGAGTACCGTTAACTCCTCAGTTATTCAGTCCCCC
  250        260        270        280        290        300        310        320        330        340        350        360
 L  L  G  K  K  I  E  P  V  I  E  D  G  A  S  D  W  P  T  F  A  E  K  A  K  K  L  L  Q  K  D  K  V  A  A  I  F  G  G  W
                   70                                    80                                    90
TCTGCTCGGCCGAAAAAGATTGAACCAGTAATCGAAGACGGCCATCAGACTGCCTACGTTCGCCGAGAAAAGCTCCTGCAGAAAGATAAGGTAGCCGGCGATTTCGGCGGTG
AGACGAGCCGGCTTTCTAACTTGGTCATTAGCTTCTGCCGATGCAAGCGCTCTTCGGTTTTTCGAGACGCTCTTTCTATTCCATCGCCGCTAAAAGCCGCCAC
  370        380        390        400        410        420        430        440        450        460        470        480
 T  S  A  S  R  K  A  M  L  P  V  V  E  Q  N  N  G  L  L  W  Y  P  V  Q  Y  E  G  M  E  S  S  P  N  I  F  Y  T  G  A  T
                         110                                    120                                    130
GACCAGTGCATCACGTAAAGCAATGTTACCAGTGGTCGAGCAGAGAATAACGGGCTCTTATGGTATCCGGTACAGTACGAAGGCATGGAATCAAGCCCAAATATCTTTTATACGGGTGCGAC
CTGGTCACGTAGTGCATTCGTTACAATGGTCACCAGCTCGTCGTCTTATTGCCCGAGAATATCCATAGGCCACATGAGCCGAGTCCGTACCCTAGTTCGGGTTTATAGAAAATGCCCACGCTG
  490        500        510        520        530        540        550        560        570        580        590        600
 T  N  Q  Q  I  V  P  A  V  S  W  L  L  E  N  R  G  K  R  F  F  L  L  G  S  D  Y  V  F  P  R  T  A  N  K  I  I  K  A  Q
                               150                                    160                                    170
CACAAAACCAGCAGATTGTCCCGGCCGTCTCCTGGCTCCTCGAGAACCGTGGCAAACCGTTTCTTTTTTTATTGGGTAGCCGATTATGTATTCCCTCCGACACAGCAAATAAGATCATTAAGGCCCA
GTGTTTGGTCGTCTAACAGGGCCGGCAGAGGACCGAGGAGCTCTTGGCACCGTTTGCCGAAAAAAATAACCATCGCTAACTATCATAAGGAGGCCTGTCGTTATTCTAGTAATTCCGGGT
  610        620        630        640        650        660        670        680        690        700        710        720
 L  K  A  E  G  G  Q  L  V  G  E  E  Y  T  P  L  G  H  T  D  Y  S  T  I  I  N  K  I  K  E  V  K  P  D  V  V  F  N  T  L
                                     190                                    200                                    210
GCTGAAAAGCCGAGGGGGGCCCCCCGTTGAGCATCCCCTTCTTATGTGCGGTGAACCCGTGTGCCTGATGAGATGAGTAATGGTAGTAATTGTTTAATTCTCCAGTTTGGACTACATCAGAAGTTGTGAA
CGACTTTCGGCTCCGGGCTCCCCCCGGGCTAACGACTCGTAAGACTCGAGCATTCAAACTCGTTGCGTTGGGAAGCCACTTGGGCACACGCCACTTGGGCAGATGTACAAAATTAAAGAGGTCAAACCTGCATGTAGTCTTCAACACCTT
  730        740        750        760        770        780        790        800        810        820        830        840
 N  G  D  S  N  V  A  F  F  K  Q  L  K  D  A  G  I  T  A  K  D  V  T  V  M  S  V  S  I  A  E  E  I  R  G  I  G  G  D
                                           230                                    240                                    250
GAATGGTGATTCTAACGTAGCCTTTTCAAACAGCTCAAGGATGCCGTATCACCCGAAGGACGTAACGGTCATGAGTGTAAGCATTGCAGAAGAAGAGAATTCGCGGGATCGGCGGGA
CTTACCACTAAGATTGCATCCGGAAAAAGTTTGTCGAGTTCGTAGTCCATAGGTGGCGTTCCTGCATTGCGAGTACTCACATTGGCTACCTCTAAGCGCCTTCTTCTCTAAGCCGCCGGGGCCGCCCT
  850        860        870        880        890        900        910        920        930        940        950        960
```

```
        V  L  A  G  H  L  A  V  W  N  Y  F  Q  S  T  D  T  P  E  N  K  A  F  V  E  K  Y  K  K  K  Y  G  K  E  R  V  T  D  D  P
        TGTATTAGCAGGTCACTTAGCAGTCTGGAACTACTTTCAAAGTACTACAGACACGCCCGAGAATAAAGCCTTCGTAGAAAAGTACAAAAGAAATACAAAAAGAAATATGGTAAAGAACGCGTCACGGACGACCC
        ACATAATCGTCCAGTGAATCGTCAGACCTTGATGAAAGTTTCATGTCTGTGCCGGCCATCTTATTTCGGAAGCATCTTTTTATTTCTTTTATACCATTCTTGCCGCAGTGCCTGCTGGG
        970        980        990        1000       1010       1020       1030       1040       1050       1060       1070       1080

I  E  A  A  Y  F  A  V  H  L  W  A  E  A  V  K  K  A  G  S  F  D  V  D  K  V  K  K  A  A  D  G  I  E  Y  K  A  P  G  G
        TATTGAGGCGGCTGTATTTCGCGGTGCATTTATGGCAGAAGCAGTCAGTTAAGAAAGCCGGCTCCTTCGACGTCGATAAGGTTAAGAAAGCGGCCGACGGGATTGAATACAAAGCGCCTGGCGG
        ATAACTCCGCCGCATAAAGCCACGTAAATACCGTCTTCGTCAGTTTCGGCCGAGAAGCTGCAGCTATTCCAATTCTTTCGCCGGACCGCGCCCTAACTTATGTTCGCGGACCGCC
        1090       1100       1110       1120       1130       1140       1150       1160       1170       1180       1190       1200

T  V  K  I  D  G  E  T  Q  H  T  W  K  I  V  R  I  G  E  I  Q  A  N  G  Q  F  K  E  L  W  N  S  G  K  A  V  K  P  D  P
        TACAGTTCAAAATTGATGGTGAGACGCAGCACACTGGAAAATTGTACGCCATCGGCGGAGATCCAAGCGGTCAGTTCAAAGAGCTCTGAATAGTGGAAGGCAGTCAAACCGATCC
        ATGTCAGTTTTAACTACCACTCTGCCTGCGTGTGACCTTTTAACATGCGGTAGCGTTTGCCAGTCCAGTCAAGTTTCTCGAGACCTTATCACCCTTCCGTCAGTTGGCCTAGG
        1210       1220       1230       1240       1250       1260       1270       1280       1290       1300       1310       1320

Y  L  K  S  Y  P  W  A  K  N  L  N  G  G  S  H  H  H  H  H  H  *  *  *
        TTATCTCAAGTCGTACCCATGGGCCAAAAATCTGAATGGCGGTTCTCATCATCATCATCATCATTAATGAAAGGCCGATATCCAGCACACTGGCCGCCCGGTTACTAGTGGATCCGGCTGCT
        AATAGAGTTCAGCATGGCTACCCGGTTTTTAGACTTACCGCCAAGATGAGTAGTAGTAGTAGTAGTAATTACTTTCGGCTATAGGTCGTGACCGCCGCAATGATCACCTAGGCCGACGA
        1330       1340       1350       1360       1370       1380       1390       1400       1410       1420       1430       1440

AACAAAGCCCAAAGAAGCTGAGTTGGCTGCTGCCACCGCTGAGCAATAACTAGCATAACCCCCTTGGGCCTCTAAACGGTCTTGAGGGGTTTTTTGCTGAAAGGAGAACTATATCC
        TTGTTTCGGGCTTTCCTTCGACTCAACCGACGACGGTGGCGACTCGTTATTGATCGTATTGGGAACCCCGGAGATTTGCCCAGAACTCCCAAAAAACGACTTTCCTCCTTGATATAGG
        1450       1460       1470       1480       1490       1500       1510       1520       1530       1540       1550       1560

GGAGCGACTCCCACGGCACGTTGGCAAGCTCGAAGCTCGAATTCGGCGTAATC
        CCTCGCTGAGGGTGCCGTGCAACCGTTCGAGCCTTAAGCCGCATTAG
        1570       1580       1590       1600

FIG. 21 (Continued)
```

FIG. 22 - Exemplary Expression Construct for ctUBP6

```
GCCAGTAAGCTTCGGTACGCTTGGGACTTGCCATAGCCTGGCCCGGTGATGCCGGACGATGCGTCCGGCGTAGAGGATCGAGATCTCGATCCCGCGAAATTAATACGACTCACTATAG
CGGTCATTCGAAGCCAGTGCAACCCTGAACGGTATCCGACCGGGCCACTACGGCCGTGCTACGCAGGCCATCTCCTAGCTCTAGAGCTAGGGCGCTTTAATTATGCTGAGTGATATC
        10        20        30        40        50        60        70        80        90       100       110       120
                                                                                    M  V  E  E  P  V  D  N  K  P  G  T  D  T  S  A  E  D  T  I
GGAGACCACAACGGTTCTCCCTCTAGAAATAATTTTGTTTAACTTTAAGAAGGAGATATACCATGGTTGAAGAACCAGTAGATAATAAACCAGGTACCGACACTTCAGCAGAGGACACGAT
CCTCTGGTGTTGCCAAGAGAGATCTTTATTAAACAAATTGAAATTCTTCCTCATATATGGTACCAACTTCTTGGTCATCATTTGGTCATGCTGTGAAGTCGTCTCCTGTGCTA
       130       140       150       160       170       180       190       200       210       220       230       240
 K  V  G  I  L  H  S  L  S  G  T  M  A  I  S  E  V  S  L  K  D  A  E  L  M  A  I  E  E  I  N  Q  A  G  G  L  L  G  K  K
CAAGGTCGGACATTTACATTCACTGTCGGCACTATGGCAATCTCCGAGGTCTCCCTCAAAGATGCCGAACTCATGGCAATTGAAGAAATAAACCAAGCAGGTGGGCTTTAGTAAAAA
GTTCCAGCCGTAAATGTAAGTGACAGACCGTGATACCGTTAGAGGCTCAGAGGAGTTTCTACGGCTTGAGTACGTTAACTTCTTTAATTGGTTCGTCCACCGAAATCCATTTT
       250       260       270       280       290       300       310       320       330       340       350       360
 I  E  P  V  I  E  D  G  A  S  D  W  P  T  F  A  E  K  K  L  Q  N  D  K  V  A  T  V  F  G  C  W  T  S  A  S  R
AATCGAACCAGTAATTGAAGACGGGGCCTCCGACTGGCCTACATTCGCTGAAAAGAAGTTACTTCAAAACGACAAAGTTGCAACCGTCTTCGGCTGTTGGACATCCGCATCCCG
TTAGCTTGGTCATTAACTTCTGCCCCGGAGGCTGACCGGATGTAAGCGACTTTTCGTTCAATGAAGTTTTGCTGTTTCAACGTTGGCAGAAGCCGACAACCTGTAGGCGTAGGCGC
       370       380       390       400       410       420       430       440       450       460       470       480
 K  A  V  L  P  V  F  E  E  N  N  G  L  L  W  Y  P  V  Q  Y  E  G  M  E  S  S  P  N  I  F  Y  T  G  A  A  P  N  Q  Q  I
TAAAGCTGTCTTGCCAGTCTTCGAGGAGAACAACGGGTTACTGTGGTATCCGGTACAATACGAGGGCATGGAATCAAGCCCAAACATTTTTACACAGGGCCGCTCCGAATCAGCAGAT
ATTTCGACAGAACGGTCAGAAGCTCCTCATTGTTGCCCAATGACACCATATAGGCCATGTATGCTCCGTAGTTCGGGTTTTGTGAAAAATGTGTCCCGGCGAGCGTTAGTCGTCTA
       490       500       510       520       530       540       550       560       570       580       590       600
 V  P  A  V  E  W  L  L  E  N  K  K  G  K  R  F  F  L  L  G  S  D  Y  V  F  P  R  T  A  N  K  I  I  K  A  Q  L  S  A  I  G
TGTACCAGCAGTGGAATGGCTCTTAGAGAATAAAGGCAAACGGTTCTTCTTCCTTGGCTCGAGTATTCCACGCACGCGCAAATAAGATTATTAAGGCGGCAGCTGTCCGCAATCGG
ACATGGTCGTCACCTTACCGAGAATCTTTATTTCCGTTTGCCAAGAAGAAGAGGAACCGAGCCTAATGCATAAGGCTGCGCGGCGTTTATTCTAATAATTCCGCGTCGACAGGCGTTAGCC
       610       620       630       640       650       660       670       680       690       700       710       720
 G  E  L  I  A  E  E  Y  T  P  L  G  H  T  D  Y  S  T  I  V  N  K  I  K  T  A  K  P  D  V  F  N  T  L  N  G  D  S  N
GGGGGAGCTTATTGCCGAGGAATGCCTCTTAGAGAGTCACACTCCATTGGGTCACACCGACTATAGTACCATTGTCAACAAAATCAAGACGGCGAAGCCGGATGTAGTATTCAACATTGAACGGGGACTCCAA
CCCCCTCGAATAACGGCTCCTTACGGAGAATCTTTTATTTCCGTTGAGGTAACCCAGTGTGGCTGATATCATGGTAACATCATGGTAACAGTGTTTAGTTGCTCCGCGTTCGGCCTACATCATAAGTTGTAACTTGCCCCTGAGGTT
       730       740       750       760       770       780       790       800       810       820       830       840
 V  A  F  F  K  Q  L  K  D  A  G  I  T  S  E  D  I  T  V  C  S  V  S  V  A  E  E  E  I  R  G  I  G  A  E  N  I  K  G  H
CGTTGCCTTCTTCAAACAGCTCAAAGACGCGGGGATCACCTCCGAAGACATTACCGTCAGTGTTCAGCGTCCAGCCTATGTTCAGTGACACATTACCGTCAGCGTCAGTCGCAGCCGATCGTGCGCATCCGGAAGACGAAATTCGTGCGCATCGTGCGGGGCATCGGCGCCGAAGAAATATTAAGGGCA
GCAACGGAAGAAGTTGTCGAGTTTCGCGCCCCTAGTGGAGGCTTCGTAATGGCATACAGTCAGTCGCATACAAGTCAGTGCATACAAGTCGCCCGGCGGCCGGCGTTCTAAGACCGTAGCCGCCGGCTTGCCTAGCCTGTAGGGCCGAAAATATTTATAATTCCCCGT
       850       860       870       880       890       900       910       920       930       940       950       960
```

```
              L  V  S  W  N  Y  Y  Q  T  T  D  T  P  E  N  K  E  F  V  E  K  Y  K  S  K  Y  G  S  D  R  V  T  D  D  P  I  E  A  A  Y
           CCTCGTTAGTTGGAAACTACTACCAAACTGACACCCGACACCCCGGAAAATAAGGAGTTCGTCGAGAAGTATAAATCGAAATGAAGTATACCCTCGCTGGCGACGACCGGTCACCGACGATGATCCAATTGAGGCAGCCTA
           GGAGCAATCAACCTTGATGATGGTTTTGGTGTGGGCTGTGTGGGCTGTGTGGCTGTTTGGTGTGGGCTGTGTGGCTGTTTGGTGTGGGCTGTGTGGCT
              970        980        990       1000       1010       1020       1030       1040       1050       1060       1070       1080
              I  A  V  H  L  W  A  E  A  V  K  K  A  G  S  F  E  V  E  K  V  K  E  A  A  K  G  L  E  F  K  A  P  E  G  L  V  K  I  E
           CATCGCCGTACACTTATGGCAGAGAAGCAGTCAAGAAGCAGGGTCGTTTGAAGTAGAGAAAGTGAAAGAGGCCGCCAAGGGCTTAGAGTTTAAAGCCTGAAGGGTTAGTAAAGATCGA
           GTAGCGGCATGTGAATACCCGTCTTCGTCAGTTCGTTCGTCAGTTCATCTCTTCACTTTCACTTTTCACTTCTCCGGCGGTTCCCAGCAAACTTCAAATTCGGGACTTCCAATCATTTCTAGCT
             1090       1100       1110       1120       1130       1140       1150       1160       1170       1180       1190       1200
              G  E  N  Q  H  L  W  K  P  V  R  I  G  E  V  Q  E  D  G  L  I  K  E  I  W  S  T  S  E  A  V  R  P  D  P  Y  L  K  T  Y
           GGGGAGAATCAGCAGCATCTCTGGAAGCCAGTCCGTATTGGTGAAGTACAGGAGGACGGTTTAATCAAGGAGATCTGGTCGACCAGCAGTCCGTCCGTCCGGACCCTACTTGAAAACTTA
           CCCCCTCTTAGTCGTCGTAGAGACCTTCGGTCAGGCAGTACCCATAACCACTTCATGTCCTCCGCCAAATTAGTTCCTCTAGACAGCTGGTCGTCGTCAGGCAGCCTGGGAATGAACTTTTGAAT
             1210       1220       1230       1240       1250       1260       1270       1280       1290       1300       1310       1320
              D  W  A  K  G  L  S  D  G  G  S  H  H  H  H  H  H  *
           CGATTGGGCCAAAGGCCTCAGCGATGGGCTAGTCATCATCATCATCATCATTAATGAAAGGGCGATATCCAGCACACTGGCGCCGTTACTAGTAGTACTAGTCGATCCGGCTGCTAACAAAGCCCGA
           GCTAACCCGGTTTCCGAGTCGCTACCCATCAGTAGTAGTAGTAGTAGTAATTACTTTCCCGCTATAGGTCGTGTGACCGCAATGATCACCTAGCCGACGATTGTTCGGCT
             1330       1340       1350       1360       1370       1380       1390       1400       1410       1420       1430       1440

AAGGAAGCTGAGTTGGCTGCTGCACCGCTGCACCGCTGAGCAATAACTAGCATAACCCCTTGGGCCTCTAAACGGTCTTGAGGGTTTTTGCTGAAAGGAGGAACTATATCCGGAGCGACTCCC
           TTCCTTCGACTCAACCGACGACGGTGCCGACTCGTTATTGATCGTATTGGGAACCCCGGAGATTTGCCCAGAACTCCCCAAAAAACGACTTCCTCCTTGATATAGGCCTCGCTGAGGG
             1450       1460       1470       1480       1490       1500       1510       1520       1530       1540       1550       1560

ACGGCACGTTGGCAAGCTCGGAATTCGGCGTAATC
           TGCCGTGCAACCGTTCGAGCCTTAAGCCGCATTAG
             1570       1580       1590

FIG. 22 (Continued)
```

FIG. 23 - Exemplary Expression Construct for csUBP7

```
              270                 280                      290
Y F Q S V D T P E N K E F V E K Y K K K Y G E D R V T D D P I E A A Y I G V Y L
CTATTTCCAAAGTGTAGATACACCGGAAAACAAGGAGTTCGTTGAGAAATATAAGAAAAAGTATGGGGAGGACCGGGTGACAGATGACCCAATCGAGGCGGCATACATCGGCGTATACTT
GATAAAGGTTTCACATCTATGTGGCCTTTGTTCCTCAAGCAACTCTTTATATTCTTTTCATACCCCTGCCCACTGTCTACTGGGTTAGCTCCGCCGTATGTAGCCGCATATGAA
             970       980       990      1000      1010      1020      1030      1040      1050      1060      1070      1080

310                     320                        330
W A K A V E K A G S T D V D K V R E A A K G I E F N A P E G P V K I D G D N Q H
ATGGGCTAAAGCGGTTGAGAAGCGGTCGACACAGACGTGGATAAGGTCCGGGAGGCCGCGGAAGGGCATCGAATTTAACGCCCAGAGGGCCCAGTAAAGATTGACGGCGACAACCAGCA
TACCCGATTTCGCCAACTCTCCGCCAGCTGTCTGCACCTATTCCAGGCCCTCCGGCGCTTCCGTAGCTTAAATTGCGGGTCTCCGGGTCATTCTAACTGCCGCTGTTGGTCGT
            1090      1100      1110      1120      1130      1140      1150      1160      1170      1180      1190      1200

350                     360                        370
L Y K T V R I G E I L E N G Q I R E L W K T N K P V K P D P Y L K G Y E W A Q G
CCTCTACAGAGACGGTCGTATTGGTGAGATCCTGGAGAACGGTCAGATTCGTGAGTTGTGGAAAACAAATAAACCAGTAAACCAGTTATGAATGGGCACAGG
GGAGATGTCTGCCACGCCATAACCACTCTAGGACCTCTTGCCAGTTGAAGCACTCAACACCTTTGTTATTTGGTCAATTTGTCTAGTATAAATTTCCAATACTACCCGTGTCCC
           1210      1220      1230      1240      1250      1260      1270      1280      1290      1300      1310      1320

390
L S E Q G G S H H H H H H * *
GTTAAGCAGCAAGGTTGTTCACATCATGTTCACATCATCATTAATGAAAGGCCGATATCCAGCACTGGCGCCGTTACTAGTCGATCCGGCTGCTAACAAAGCCCGAAAGGAAGCTGAG
CAATTCGCCGTCGTTCCACCAAGTGTAGTAGTAGTAGTAGTAATTACTTCCCGCTATAGGTCGTGTGACCGGCCAATGATCGATCCTAGGCCGACGATTGTTCGGGCTTCCTTCCTTGACTC
           1330      1340      1350      1360      1370      1380      1390      1400      1410      1420      1430      1440

TTGGCTGCTGCCACCGCTGACAATAACTAGCATAACCCCTTGGGCCTCTAAACGGGTCTTTGAGGGTTTTTTTGCTGAAAGAGGAACTATATCCGAGCGGACTCCCACGGCACGTTGG
AACCGACGACGGTGGCGACTCGTTATTGATCGATTAATTGATCAAAAAACGACTTTCCCTTCCTTGATATAGGCCTGCCGCTGAGGGTGCCGTGCAACC
           1450      1460      1470      1480      1490      1500      1510      1520      1530      1540      1550      1560

CAAGCTCGGAATTCGGCGTAATC
GTTCGAGCCTTAAGCCGCATTAG
           1570      1580

FIG. 23 (Continued)
```

FIG. 24 - Exemplary Expression Construct for taUBP8

```
GCCAGTAAGCTTCGGTCACGCTTGGAGACTTGCCATAGCTGGACTGATGCCGCCGGTGATGCCGCACGATGCGTCCGGCGGTAGAGGATCGAGATCTCGATCCCGCGAAATTAATACGACTCACTATAG
CGGTCATTCGAAGCCAGTGCGAACCCTGAACCCTGAACTGCGACTGTCGACTGTGCTACGCAGGCCACTACGCCGGTGCTACGCAGGCCCATCCTCTAGAGCTAGGAGCGCTTAATTATGCTGAGTGATATC
         10        20        30        40        50        60        70        80        90        100       110       120
                                                                          M  K  S  G  Y  A  N  R  R  D  F  I  K  A  S  A  A  V  I  T
                                                                                                     10
GGAGACCACAACGGTTCTCCCTCTAGAAATTTAACTTTAAGAAGGAGATATACCATGAAATCAGGTTATGCTAATCGTCGGACTTTATCAAAGCGTCCGCCGCAGTCATCAC
CCTCTGGTGTTGCCAAGGAGATCTTTATTAATTGAAATCTTCCTCTATATGGTACTTTAGTCCAATACGATTAGCAGCGCTAAATAGTTTCGCAGGCGGCGTCAGTAGTG
     130       140       150       160       170       180       190       200       210       220       230       240
 L  H  T  I  A  P  A  L  V  W  P  S  P  K  K  I  K  V  G  V  L  H  S  L  S  G  T  M  A  I  S  E  V  H  V  K  N  A  T  L
                   30                                     40                                     50
CTTGCACACAATTGCACCAGCACTCGTTTGGCCAAGTCCTAAGAAGATCAAAGTCGGCGTACTCCACAGTCTGAGTGGTACTATGGCCATCTGAGGTCCACGTCAAGAACGCAACATT
GAACGTGTGTTAACGTGGTCGTGAGCAACCGGTTCAGGATTCTTCTAGTTTCAGCCGCATGAGAGTGTCAGACTCACCATGATACCGGTAGAGACTCCAGTGCAGTTCTTGCGTTGTAA
     250       260       270       280       290       300       310       320       330       340       350       360
 L  A  I  E  E  I  N  R  K  G  G  V  L  G  Y  T  I  E  P  I  I  E  D  G  A  S  D  P  A  T  F  A  Q  K  A  Q  K  L  I  L
                   70                                     80                                     90
GCTCGCCAATTGAGGAAATCAATCGTAAAGGCGGGCTACTCGGGTATACCATTGAACCTATCATTGAAGACGGGCCATCGACCAGCTACCTTCGCCACAAAAAGCACAAAATTGATTCT
CGAGCGGTAACTCCTTTAGTTAGCATTTCCGCCCGATGAGCCCATATGGTAACTTGGATAGTAACTTCTGGGAGCCTGGTCATCGATGGAAGCGTGTTTTCGTGTTTTAACTAAGA
     370       380       390       400       410       420       430       440       450       460       470       480
 M  D  K  V  V  T  V  F  G  G  W  T  S  A  S  R  K  A  M  L  P  V  F  E  R  Y  K  N  L  L  W  Y  P  Q  F  E  G  N  E
                  110                                    120                                    130
CATGGACAAAGTTGTAACCGTATTCGGTGGGTGGACGAGCAGCCGCCTAAGGCGGATGTTACCAGTCTTCGAGCCGGTACAAAAAACCTGTTATGGTACCCAGTGCAGTTCGAAGGAATGA
GTACCTGTTTCAACATTGGCATAAGCCACCCACCTGCTCGCCGGAGCGCATTCCGCTACAAGTGCAGAAGCTCGCCATGTTTTGACAATACCATGGGTCACGTCAAGCTTCCCTACT
     490       500       510       520       530       540       550       560       570       580       590       600
 A  S  P  N  I  I  Y  T  G  A  Q  P  N  Q  Q  I  L  P  A  L  E  W  A  L  K  Q  G  Y  K  K  F  F  L  V  G  S  D  Y  V  F
                  150                                    160                                    170
AGCCCTCACCAGCAAATATTATTACACCGGTGCACAACCGGTCACAACCAACAAATCCTCCCGGCTTGGAGTGGCACTTAAGCAAGTTATAAGAAGTTTTCCTGGTAGGCAGCGACTATGTCTT
TCGGAGTGGTTGATAATAAATGTGGCCACGTGTTGGCCACGTTGGCCAGCCGAATTCGTTCAATATTCTTCAAAAGGACCATCCGTCGCTGATACAGAA
     610       620       630       640       650       660       670       680       690       700       710       720
 P  R  T  A  N  L  I  L  K  K  H  H  I  Q  K  N  G  A  I  V  S  G  E  E  Y  V  P  L  G  T  D  F  S  A  V  V  N  K  I  I
                  190                                    200                                    210
CCCTCGTACCGCGAATCTGATCTTGAAGAAGCATATTCAGAAGAACGGTGCTATCGTCAGCGGCGAAGAATATGTACCTTTAGGGGGACGGACTTCAGTCGCCGTTGTAAACAAGATCAT
GGGAGCATGGCGCTTAGACATGAAGCTTTCGTATAGTCTTCTTGCCACGATAGCAGTGCGCCGCTTCTTATACATGGAAATCCCCCTGCCTGAAGTCAGCGGCAACATTTGTTCTAGTA
     730       740       750       760       770       780       790       800       810       820       830       840
 N  T  K  P  D  I  V  F  N  T  I  I  N  G  D  S  N  V  A  F  F  K  Q  M  A  A  A  G  V  G  P  K  V  L  P  V  I  S  F  S  I
                  230                                    240                                    250
CAATACAAAGCCAGACATCGTGTTCAATACCATTAATGGTGATAGTAACGTAGCTTTCTTTAAACAAATGGCAGCGGCAGGCGTTGGCCCTAAGGTCCTCCCTGTAATTAGCTTCAGCAT
GTTATGTTTCGGCTCTGTAGCACAAGTTATGGTAATTACCACTATCATTGCAGTTTGTTAAACAAAATTTGTTACGTCGTCGCGGCGGCCGTCCGCAACCGGGATTCCAGAGGGACATTAATGCTTCGAAGTCGTA
     850       860       870       880       890       900       910       920       930       940       950       960
```

```
                    270              280                    290
A  E  Q  E  A  K  A  I  G  I  P  L  L  E  G  S  Y  A  A  W  N  Y  F  M  S  L  N  N  K  A  N  L  E  F  I  K  A  Y  Q  G
CGCGGAACAAGAAGCAAAGGCAATCGGCATCCCATTATTATTGGAGAGGCTCATACGCAGCTTGGAGTTCATGTCGCTTAATAACAAGGCCAACCTGGAGTTCATTAAGGCTTATCAAGG
GCGCCTTGTTCTTCGTTCCGTTTAGCCGTTAGCCCGTTAGGGTAATAACCTCCCGAGTCGTCGAACCTTGAACCCTTGATAAAGTACAGCGAATTATTGTTCCGGTTGGACCTCAAGTAATTCCGAATAGTTCC
 970      980      990      1000     1010     1020     1030     1040     1050     1060     1070     1080

310                    320                    330
K  Y  G  K  S  S  L  I  T  D  P  M  A  H  G  Y  M  N  V  Y  L  W  K  M  A  V  E  K  A  G  T  F  D  P  M  M  V  R  K  A
CAAGTATGGTAAATCGTCATTAATCACAGATCCCATGGCACATGGCTATATGAATGTCTACCTCTGGAAGATGGCAGTAGAGAAAGGCTGGTACCTTCGACCCGATGATGGTGCGCAAAGC
GTTCATACCATTTAGCAGTAATTAGTGTCTAGGGTACGTGTACCGATATACTTACAGATGAGACATCTTTCCGACCATGGATAGCCTCGAAGCTGGGCTACTACCACGCGTTTCG
 1090     1100     1110     1120     1130     1140     1150     1160     1170     1180     1190     1200

350                    360                    370
A  T  E  L  P  W  V  D  S  P  F  G  K  I  K  I  A  K  N  Q  S  L  Y  Q  T  A  Y  I  G  K  L  G  S  D  G  Q  F  S  I  V
AGCCACAGAGCTCCCATGGGTAGACTCCCCATTCGGTAAAATTAAAATCGCTAAAATCAGTCCCTCTACCAGACCGCTATATCGGTAAGCTCGGTTCAGATGGTCAATTTTCAATTGT
TCGGTGTCTGCAGGGTACCCATCTGAGGGTAAGCCATTTTAATTTTAGCGATTTTAGTCAGGGAGATGGTCTGGCGAATATAGCCATTCGAGCCAAGTCTACCAGTTAAAAGTTAACA
 1210     1220     1230     1240     1250     1260     1270     1280     1290     1300     1310     1320

390                    400                    410
W  S  S  G  K  P  I  E  P  E  P  Y  D  K  L  V  F  P  G  K  K  A  V  L  G  G  S  H  H  H  H  H  H  *
GTGGAGTAGCCGGGAAACCTATCGAGCCTGAGCCTTACTAGTAGTATTCCCAGCCATATGATAAATTAGCTGTCATCATCATCATCATTAATGAAAGGCGATATCCA
CACCTCATCGCCCTTTGATAGCTCGGACTCGGAATCGTCTTCTTCGCCAGAATCCAACATCAGTAGTAGTAGTAGTAATTACTTTCCGCCTATAGGT
 1330     1340     1350     1360     1370     1380     1390     1400     1410     1420     1430     1440

GCACACTGGCGGCCGCCGTTACTAGTAGTAGATCCGGATCCGGGCTGCTAACAAAGCCCGAAAGGAAGCTGAGTGGCTGCTGCCACCGCTGAGCAATAACTAGCATAACCCCTTGGGCGCCTCTAAACGGGTC
CGTGTGACCGCCGGCCAATGATCACCTAGGCCGACGATTGTTTCGCCCAAGCCCTTTCCGGCTTCGACTCAACGACGACGGTGCGACTCGTTATTGATCGTATTGGGAACCCCGGAGATTTGCCCAG
 1450     1460     1470     1480     1490     1500     1510     1520     1530     1540     1550     1560

TTGAGGGGTTTTTTGCTGAAAGGAGGAACTATATCCGGAGCGACTCCACGGCAGCTTGGCAAGCTCGGAATTCGGCGTAATC
AACTCCCAAAAAACGACTTTCCTCCTTGATATAGGCCTCGCTGAGGGTGCCGTGCAACCGTTCGAACCGTTAAGCCTTAAGCCTTCATTAG
 1570     1580     1590     1600     1610     1620     1630     1640

FIG. 24 (Continued)
```

FIG. 25 – Exemplary Expression Construct for gkUBP10

```
GCCAGTAAGCTTCGGTCACGCTTGGGACTGCCATAGCTGGCCCGGTGATGCCGCCACGATGGCTCCGGCGTAGAGGATCGAGATCTCGATCCCGCGAAATTAATACGACTCACTATAG
CGGTCATTCGAAGCCAGTGCGAACCCTGACGCGTATCCGACCGGGCCACTACGGCCGTGCTACGCAGGCCATCTCCTAGCTCCTAGAGCTAGGGCGCTTTAATTATGCTGAGTGATATC
         10        20        30        40        50        60        70        80        90       100       110       120
                                                                                  M  A  E  E  S  D  N  V  D  S  A  D  A  E  E  D  D  S  D  V
GGAGACCACAACGGTTCCAAAGGAGATCTTATTAAACAACATTGAAAATTCTTCCTCTAGAAATATTTGTTTAACTTTAAGAAGGAGATATACCATGGCTGAAGAATCAGATAATGTAGATAGTGCTGACGCAGAAGAGGATGATAGCGACGT
CCTCTGGTGTTGCCAAGGTTTCCTCTAGAATAATTGTTAAACTTTTAAGAAGAGATCTTTATAAACAAATTGAAATTCTTCCTCTATATGGTACCGACTTCTTAGTCTATTACATCACGACTGCGTCTTCTCCTACTATCGCTGCA
         130       140       150       160       170       180       190       200       210       220       230       240
                  30                                              50
 W  W  G  G  A  D  T  D  Y  A  D  G  S  E  D  K  V  V  E  V  A  E  E  E  E  V  A  E  V  E  E  E  E  A  D  D  D  E  D  D
ATGGTGGGGCGGTGCCGACCGACTAGCCAGATGGCTACCGATGCTCTACCATCGCTGTTCAGCACCTTCAGCGTCTTCTGTTTCAGCGAACCTTCAGCGTCTTCCAACGACTCCATCTCCCTTCTCCCGTCTGCTCTCGCTCTTCTACT
TACCACCCCACCACGGCTGTGCTATCGGTCTACCATGGCTAGCGACATGGTAGCGACAAGTCGTCGAAGACAAATGTCGAAGAGTCGCAGAAGAGTTGCTGAGTAGGAAGAGGCAGACGACGAAGATGA
         250       260       270       280       290       300       310       320       330       340       350       360
                          70                                              90
 E  D  G  D  E  V  E  E  E  A  E  E  P  Y  E  E  A  T  E  R  T  T  S  I  A  F  T  T  T  T  T  E  S  V  E  E  V  L  E
CGAGGACGCGTGATGAGGTCGAAGAGAAGCCGAAGAACCCGTATGAGGAAGCCACAGAGCGCACTACATCGATTGCCTACAACACCACCACTGTTGAAGAAGTCCTCGA
GCTCCTGCCACTACTCCAGCTTCTTCTTCGGCCTTCTGCTCTTCGGTGTCTGCATACTCCTTCGGTGATGTAGCTACGCCATGTTGGTGGCTAGTGGTAGTCAACTTCTTCAGGAGCT
         370       380       390       400       410       420       430       440       450       460       470       480
                          110                                             130
 V  L  F  Q  G  P  A  S  S  A  V  D  Q  A  K  N  E  N  K  K  D  S  S  S  A  S  K  E  G  D  T  V  K  V  G  I  L  H  S  L
GGTTCTCTTCCAAGGGCCCGGCTAGCTCCGGCGGTCGATCAGGCTAAAGATCAGGCTAAAAACAAGAAGACTCGTCCAGTGCGTCCAGAGTGCACACAGTGAAAGTAGGGATCTTACACTCGTT
CCAAGAGAAGGTTCCCGGCCGACGTTCCCAAAGCCCTAAAGCGAGGCGCCAGCTAGCTCCGATTTTGTTCTTCCTGACGGTCACGCAGGTTCTTCCGCTGTCACTTCATCCCTAGAATGTGAGCAA
         490       500       510       520       530       540       550       560       570       580       590       600
                  150                                             170
 S  G  T  M  A  I  S  E  V  S  L  R  D  A  E  L  M  A  I  E  E  I  N  A  S  G  G  L  L  G  K  K  I  E  P  V  V  E  D  G
ATCAGGCACACAATGGCAATTTCGAGGTTCGCTCCGCGATGCAGAACTGGAGCAGAACTGATGGCAATTGAAGAATCAATGCCTCCGGCGGCCCTCTTGGGTAAAAAGATTGAACCAGTGGTAGAAGATGG
TAGTCCGTGTACCGTTACCGTTAAAGCTCCAAGCGAGGCGCTACAGCGAGGCGCTACGACTTGACCTCGTCTTAGAACTTCTTAGTTACGGAGCCGCCGGGAGAACCCATTTTCTACTTGGTCACCATCTCTACC
         610       620       630       640       650       660       670       680       690       700       710       720
                  190                                             210
 A  S  D  W  P  T  F  A  E  K  A  K  K  L  L  Q  K  D  Q  V  A  A  I  F  G  G  W  T  S  A  S  R  K  A  M  L  P  V  V  E
CGCATCGACTGGCCGACATTTGCAGAGAAGGCAAAAAAATTACTCCAAAAAGACCAGGTAGCAGCAATCTTCGGCGGTTGACTTCGACTCCGAAAGCCATGCTCCCGGTAGTCGA
GCGTAGACTGACCGGCCGGCTGTAAACGTCTCTTCCGTTTTTTTAATGAGGTTTTCTGGTCCATCGTCGTTAGAAGCCGCCAACCTGAAGGCCGAAGGCCTTCGGTACGGCCATGCGCT
         730       740       750       760       770       780       790       800       810       820       830       840
                  230                                             250
 Q  N  N  G  L  L  W  Y  P  V  Q  Y  E  G  M  E  S  S  P  N  I  F  Y  T  G  A  T  T  N  Q  Q  I  V  P  A  V  S  W  L  L
CGGCATCTGACTGACCGGCCTGTCTCTCGTGGTACCCAGTTCAGTACGAAGGCATGGAATCATCTCCAAATATCTTCTACACAGTGCAACCACCAACAGCAAATCGTACCGGCCGGTCAGCTGGCTTCT
TGTTTTATTACCAGAGGAGACCATGGGTCAAGTCATGCCTTCCGTACCTTCGTACCTTAGTAGAGGTTTATAGAAGATGTGTCCACGTTGGTTCGTTAGCATGCCGCCAGTCGACCGAAGAA
         850       860       870       880       890       900       910       920       930       940       950       960
```

```
        K  N  R  G  K  T  F  F  L  L  G  S  D  Y  V  F  P  R  T  A  N  K  I  I  K  A  Q  L  K  A  E  G  G  Q  V  V  G  E  E  Y
      CAAGAATCGCGGTAAAACTTTCTTCTTCCTGTTAGGGTCGGACTATGTATTTCCACGTACGGCAAACAAAATTATTAAAGCCCAATTGAAAGCAGAGAGGGGCCAGGTGTCGGTGAGGAATA
              970       980       990      1000      1010      1020      1030      1040      1050      1060      1070      1080
                                                              280                                 290
      GTTCTTAGCGCCATTTTGAAAGAAGACAATCCCAGTCATGATACATAAAGGTGCAAATGCCGTTTGTTTAAATAATTTCGGTGAACTTTCGTCTCCCCGGTCCAACAGCCACTCCTTAT

T  P  L  G  H  T  D  Y  S  T  I  I  S  K  I  K  Q  V  K  P  A  V  V  F  N  T  L  N  G  D  S  N  V  A  F  F  K  Q  L  K
      TACCCCGTTAGGGCATACAGATTACAGTACCATTATTTCAAAGATCAAACAGGTCAAGCCGTAGTATTTAACACCCTCAACGGTGACTGACTGAACTGAGCTTTTTTCAAACAGCTTAA
             1090      1100      1110      1120      1130      1140      1150      1160      1170      1180      1190      1200
                                                              320                                 330
      ATGGGGCAATCCCGTATGTCTAATGTCATGGTAATAAAGTTTCTAGTTTGTCCAGTTCGGCCGGCCATCATAAATTGTGGAGTTGCCACTGAGTTGCATCGAAAAAGTTTGTCGAATT

D  A  G  I  T  P  K  D  V  T  V  M  S  V  S  I  A  E  E  I  R  G  I  G  P  D  V  L  A  G  H  L  A  V  W  N  Y  F  Q
      GGACGCTGGGATTACCCCTAAAGATGTCACCGTTATGTCCGTATCTATCGCAGAAGAGAAATTCGTGGGATTGGGCCAGATGTCCTCGGCAGGTCACCTCGCCGTATGGAACTATTTCA
             1210      1220      1230      1240      1250      1260      1270      1280      1290      1300      1310      1320
                                                              360                                 370
      CCTGCCGACCCTAAATGGGGATTTCTACAGTGCAATACAGGCATAGACATAGCGTCTTCTCCTTTAAGCACCCGGTCTACAGAGACCGTCCAGTGGAGCGGCATACCTTGATAAAAGT

I  T  D  P  E  N  K  A  F  V  Q  K  Y  K  E  K  Y  G  Q  D  R  V  T  D  D  P  I  E  A  A  Y  T  A  V  H  L  W  A  E
      AACTACAGATACACCCGAAAATAAAGCATTCGTTCAGAAGTATAAAGAGAAGTATGGCCAGGATCGCGTTACTGACGACCCAATTGAGGCCGCTACACCGCAGTACATTTATGGGCAGA
             1330      1340      1350      1360      1370      1380      1390      1400      1410      1420      1430      1440
                                                              400                                 410
      TTGATGTCTATGTGGCCTTTATTCGTAAGCAAGTCTTCATATTTCTCTTCATGCCGCAATGACTGCTCCTAGCGCAATGACTGCTCCTGGGTTAACTCCTGTAACTCCATGTAAATACCCGTCT

A  V  K  K  A  G  S  F  D  V  D  Q  V  K  K  A  A  A  G  L  E  Y  K  A  P  E  G  T  V  K  I  D  G  E  T  Q  H  L  W  K
      GGCAGTGTAAGAAAGCAGGCTCTCTTCGACGTCGATCAGGTTAAAGAAGGCCGCAGTCTGGGCTGAATATAAAGCACCAGAGGGTACAGTGAAAATTGATGGTGAGACTCAACACTTGTGGAA
             1450      1460      1470      1480      1490      1500      1510      1520      1530      1540      1550      1560
                                                              440                                 450
      CCGTCAATTCTTCGTCCGACAAAGCTGCAGCTAGTCCATTTCTTCCGAGACCTATCGCCAGTTCAAGTTGGTCAATTGCCACTTCGTGGTCTCCATGTCACTTTAACTCACCTGAGTTGTGAACACCTT

T  V  R  I  G  E  I  Q  A  D  G  Q  F  K  E  L  W  N  S  G  Q  P  V  K  P  D  P  Y  L  K  S  Y  P  W  A  K  G  L  S  E
      GACCGTGCCGTATCGGTCGAGATTCAAGCCGACGGGCAGTTCAAGAGCTCTGGAATAGCGGCCCAACCAGTTAAACCAGATCCATATTTAAAGTCATATCCATGGGCGAAAGGCCTCTCGA
             1570      1580      1590      1600      1610      1620      1630      1640      1650      1660      1670      1680
                                                              480                                 490
      CTGGCACGCACATAGCCACTCTAAGTTCGGCTGCCCGTCAGCTAGTCGCATTCGTCGAGACCTTATCGCCAGTTCTAGGTCGACGATCACCTAGGCCGACGATTGTTTCGGCGATTTTCCTGACTCAACCGA

G  G  S  H  H  H  H  H  H  *  *
      AGGCGGTTCACATCATCATCATCATCATTAATGAAAGGGGCGATATCCAGCACACTGGCGCCGTTACTAGTGGATCCGGATCTGCTAACAAAGCCCGAAAGGAAGCTGAGTTGGCT
             1690      1700      1710      1720      1730      1740      1750      1760      1770      1780      1790      1800
                                                              510
      TCCGGCCAGTGTGTAGTAGTGATCGTATTGATCGTATTGATCGTAATTACTTTCCCGGTGAACTTGGGAACCCCGGAGATTTGCCCAGAACTCCCCAAAAAACGACTTTCTCGGGCTTTCCGGAGCTTCAACCGA

GCTGCCACCGCTGAGCAATAACTAGCATAAACCCCTTGGGCCTCTAAACGGGTCTTGAGGGGTTTTTTGCTGAAAGGAGGAACTATATCCGAGCGACTCCCACGGCACGTGGCAAGCT
             1810      1820      1830      1840      1850      1860      1870      1880      1890      1900      1910      1920
      CGACGGTGCCGACTCGTTATTGATCGTATTGATCAGTAGTAATTGATGAGGCTCTGAAGAACTGCAGAGACTTTCCTCCTTGATATAGGCCTCGCTGAGGGTGCCGTGCAACCGTTGA

FIG. 25 (Continued)
```

CGGAATTCGGCGTAATC
GCCTTAAGCCGCATTAG
1930

FIG. 25 (Continued)

FIG. 26 – Exemplary Expression Construct for psUBP11

```
GCCAGTAAGCTTCGGTCACGCTTGGGACTTGCCATAGCTGGCCCGGTGATGCCGCCACGATGCCTCCGGCGTAGAGATGCGAGATCTCGATCCCGCGGAAATTAATACGACTCACTATAG
CGGTCATTCGAAGCCAGTGCGAACCCTGACGGTATCCGACCGGGCCACTACGGCCGTGCTACGCAGGCCCATCTCCTAGCTCTAGAGCTAGGCGCTTTAATTATGCTGAGTGATATC
        10        20        30        40        50        60        70        80        90       100       110       120
                                                                                    M   A   E   E   S   D   N   V   D   S   A   D   A   E   E   D   D   S   D   V
                                                                                                    10
GGAGACCACAACGGTTCTCCCTCTAGAAATAATTTGTGTTAACTTTAAGAAGGAGATATACCATGGCTGAAGAAAGTGATAATGTAGATAGCCGAGGAAGACGACTCGGACGT
CCTCTGGTGTTGCCAAGAGGAGATCTTTATTAAACAATTGAAATTCTTCCTCTATATGGTACCGACTTCTTCACTATTACATCTATCACGACTCGGCTCCTTCTGCTGAGCCTGCA
       130       140       150       160       170       180       190       200       210       220       230       240
 W   G   G   A   D   T   D   Y   A   D   G   S   E   D   K   V   V   E   V   A   E   E   E   E   V   A   E   V   E   E   E   A   D   D   E   D   D
                         30                                          40                                          50
CTGGTGGGGCGGTGCTGACACCGATTATGCTGACGGTCAGAAGATAAAGTCGTGAGGTAGCTGAGGAAGAAGAAGTCGCCGAGTAGAAGAAGAAGCCGATGATGACGAAGACGA
GACCACCCCACCACGACTGTGGCTAATACGACTGCCAGTCTTCTATTTCAGCACCTCAGACTCCATGGCTCCATCTCCTCTTCAGCGCTCCATCTTCTTCTTCGGCTACTACTGCTTCTGCT
       250       260       270       280       290       300       310       320       330       340       350       360
 E   D   G   D   E   V   E   E   E   A   E   E   P   Y   E   E   A   T   E   R   T   T   S   I   A   T   T   T   T   T   E   S   V   E   E   V   L   E
                         70                                          80                                          90
CGAGGACGCGTGATGAGGTTGAGGAAGAGCCGAAGAGCCCATACGAGGAGGCCACTGAACGCTAGTATCCAACGATATCGACCACCACTAGTAGTCAGTCAGGAAGTACTCGA
GCTCCTGCCACTACTCCAACTCCTTCCGGCTTCTCCGGTATGCTCCTCGTGTGACTTGCGTGTTGATCATAGCCGTTGTGTTGTCCTCAGTCAGCTCCTTCATGAGCT
       370       380       390       400       410       420       430       440       450       460       470       480
 V   L   F   Q   G   P   K   E   T   A   P   T   A   G   A   G   N   G   S   P   P   V   E   A   A   G   D   S   I   K   V   G   I   L   H   S   L   S   G   T
                        110                                         120                                         130
AGTCCTCTTCAAGGCCCAAAGGAAACTGCACCTACGGCCAGGCCAGCCACCGTAGAAGCCGGGCCATTAAGGTCGGCATCCTCCACAGTCTCTCAGGCAC
TCAGGAGAAAGTTCCGGGTTTCCTTTGACGTGGATGCCGGTCCGCCGGTCGTCGGTGCTCGATTCTCGTAATTCGATCCAGCCGTGCACATAGCTCCTGCCGGAGTCCGTG
       490       500       510       520       530       540       550       560       570       580       590       600
 M   A   I   S   E   V   S   V   K   D   A   E   M   L   A   I   E   E   I   N   A   A   G   G   V   L   G   K   Q   I   E   P   V   I   E   D   G   A   S   D
                        150                                         160                                         170
CATGGCGATTCCGAAGTCAGTCGTGAAGGACGCAGAAATGTTAGCCATCGAAGAAATCAACGCCGCAGGGGGTGTACTGGGTAACAAATCGAGCCTGTTATCGAGGACGCGCCTCCGA
GTACCGCTAAGGCTTCAGTCAGCTTCACACTTCGTCTTCTGCGTCTTTACAATGCGGTAGCTCTTCAATTGGTCGGTCGGCCCACATGACCATTGTTTAGCTCGGACATACGCTCCTGCCGGAGGCT
       610       620       630       640       650       660       670       680       690       700       710       720
 W   P   T   F   A   E   K   A   G   K   L   L   Q   Q   D   K   V   A   A   V   F   G   G   W   T   S   A   S   R   K   A   M   L   P   V   F   E   Q   N   H
                        190                                         200                                         210
CTGGCCAACATTCGCGGAAAAGGCAGTAAATTACTTCAGCAAGACAAGGTTGCAGCGGTATTTGGTGGGTGGACTTCAGCCAGTCGCAAAGCTATGCTCCCAGTCTTCGAACAAACCA
GACCGGTTGTAAGCGCCCTTCCGTCATTTAATGAAGTCGTTCTGTTCCAACGTCGCCATAAACACCACCTGAAGTCGGTCAGCGTTCGATACGAGTCAGAACTTGTTGGT
       730       740       750       760       770       780       790       800       810       820       830       840
 G   L   L   F   Y   P   V   Q   Y   E   G   L   E   S   S   P   N   I   F   Y   T   G   A   T   T   N   Q   Q   I   V   P   S   V   S   W   L   L   E   N   R
                        230                                         240                                         250
TGGTCTGCTCTTTATCCGGTCCAATACGAAGGCCTCGAATCTTCCCAAACATCTTCTACACGGGCCAACGACTAATCAACAGATGTATCCTGGCTCTTGGAGAATCG
ACCAGACGAGAAATAGGCCAGTTATGCTTCCGGAGCTTAGAAGCTTTGTGAAGATGCCGCCGGTTGCTGATTAGTTGTCTAGAAGATGTCCTTCACATGGTTCAATAGGACCAGGAACCTCTAGC
       850       860       870       880       890       900       910       920       930       940       950       960
```

```
          G  K  K  M  F  L  L  G  S  D  Y  V  F  P  R  T  A  N  K  I  I  K  A  Q  L  T  A  E  G  G  E  L  A  G  E  E  Y  T  P  L
       TGGCAAGAAAATGTTCCTCTTGGGGTCCGATTACGTATTCCCGCGTACTGCAAATAAATTATTAAAGCTCAATTAACGGCGGAAGGTGGCGAATTAGCCGGAAGAGTACACCCCTTT
       ACCGTTCTTTTACAAGGAGAACCCCAGGCTAATGCATAAGGCGCATGACGTTATTTAATAATTTCGAGTTAATTGCCGCCTTCCACCGTTGGCCGCCTTCTCATGTGGGAAA
            970        980        990       1000       1010       1020       1030       1040       1050       1060       1070       1080

G  H  T  D  F  S  T  I  I  A  K  I  K  E  A  K  P  D  I  V  Y  N  T  L  N  G  D  S  N  V  A  F  F  K  Q  L  K  D  A  G
       GGGTCATACAGACTTCTCAACAATTATTGCAAAGATCAAGGAGGCAAAGCCAGACATCGTGTACAATACTCTCAATGGGATAGTAGCATTCTTTAAGCAACTGAAAGACGCTGG
       CCCAGTATGTCTGAAGAGTTGTTAATAACGTTTCTAGTTCCTCCGTTTCGGTCTGTAGCACATGTTATGAGAGTTACCCCTATCATTACATCGTAAGAAATTCGTTGACTTCTGCGACC
           1090       1100       1110       1120       1130       1140       1150       1160       1170       1180       1190       1200

T  T  S  K  D  M  T  T  L  S  V  S  V  A  E  E  I  R  G  I  G  A  D  I  L  E  G  H  L  A  A  W  N  Y  Y  Q  S  T  D
       GACTACAAGTAAAGATATGACCACCCTCTCGTTGTCGTCGCAGAAGAAGAAATCCGCGGCATTGGTGTCAGACATTTTAGAGGTCATTTGGCCGCCTGGAACTACTACAGAGACACGA
       CTGATGTTCATTTCTATACTGGTGGGAGACAAAGCCAGCGTCTTCTTCTTTAGCGCCGTAACCACAGTCTGTAAAATCTGTAAGGACCTTGATGATGATAGTCTCGTGTCT
           1210       1220       1230       1240       1250       1260       1270       1280       1290       1300       1310       1320

T  P  E  N  K  A  F  V  D  K  Y  K  A  K  Y  G  A  D  R  V  T  A  D  P  I  E  A  G  Y  T  A  V  Y  L  W  K  A  A  V  E
       TACTCCAGAGAATAAAGCCTTCGTTGATAAATATAAAGCTAAGTATGGTGCAGACCGGGTCACGGCCGACCCAATTGAAGCCTATACCCAGTCCAGTCAGTCAGGCGGGTCGA
       ATGAGGTCTCTATTTCGAAGCAACTATTATATTTCGATTCATACAGTCGGCTGGGGCCCCAGCTATGGCGTCAGATGGCGTTAACTTCGAAGACCTTCGTCGCCAGCT
           1330       1340       1350       1360       1370       1380       1390       1400       1410       1420       1430       1440

K  A  G  T  T  D  V  D  K  V  K  E  A  A  K  G  I  E  F  A  A  P  E  G  K  V  T  I  D  G  D  N  Q  H  H  K  T  V  R
       AAAGGCCAGGTACTACAGATGTGACAAAGTCAAAGAGGCCGCTAAAGGTATTGAGTTCGCTGCTGCCCCAGAGGGGAAGGTCACTATTGATGGCGACAATCAACACATTCATAAGACCGTGCG
       TTTCCGTCCATGATGTCTACATCTGTTTCAGTTTCTCCGGCGATTTCCATAACTCAAGCGACGACGGGGTCTCCCCTTCGATGATAACTACCGCTGTTAGTTGTGTAAGTATTCTGGCACGC
           1450       1460       1470       1480       1490       1500       1510       1520       1530       1540       1550       1560

I  G  E  V  Q  A  D  G  Q  F  K  E  L  W  N  S  G  E  P  V  K  P  D  P  Y  L  K  T  Y  D  W  A  K  G  L  S  G  E  G  G
       TATCGGTGAGGTCCAAGCAGACGGACAGTTTAAAGAATTATGGAACTCGGGGGAGCCAGTAAAACCGGACCCATATTTAAAAACATATGACTGGGCAAAAGGCTTGTCGGGGGAAGTGG
       ATAGCCACTCCAGGTTCGTCTGCCTGTCCGGTCAAATTTCTTAATACCTTGACCCCCCTCGGTCATTTTGGCCTGGGTATAAAATTTTTGTATACTGACCCGTTTCCGAACAGCCCCTTCCACC
           1570       1580       1590       1600       1610       1620       1630       1640       1650       1660       1670       1680

S  H  H  H  H  H  H  *
       TAGTCATCATCATCATCATTAATGAAAGAAGGGCGATATCCAGCACACTGGCCGTTACTGGATCCGCGTCTAACAAAGCCCGAAAGGAAGCTGAGTTGCTGCTGCCACCGCT
       ATCAGTAGTAGTAGTAGTAATTACGTTCCCGCTATAGGTCGTGTGACCGGCCAATGATGATCACCTAGGCGCAGATTGTTCGGCGTTCCTTGACTCAACGACGACGGTGGCGA
           1690       1700       1710       1720       1730       1740       1750       1760       1770       1780       1790       1800

GAGCAATAACTAGCATAACCCCTTGGGCCTCTAAACGGGTCTTTTTGCTGAAAGAGGAACTATCCGGAGCGACTCCCACGGCACGTTGCCAAGCTCGAAGCTCGAATTCGGCG
       CTCGTTATTGATCGTATTGGGAACCCCCCAAAAAACGACTTTCCTTGATGATTAATATAGGCCTGCGAGGGGTCCGCAACCGTTGCAGCCGTTCGAGCCGTTAAGCCGC
           1810       1820       1830       1840       1850       1860       1870       1880       1890       1900       1910       1920

FIG. 26 (Continued)
```

TAATC
ATTAG

FIG. 26 (Continued)

FIG. 27 - Exemplary Expression Construct for teUBP12

```
GCCAGTAAGCTTCGTGCACGCTTGGGACTTGCCATAGCTGGCCCGGTGATGCCGCCACGATGCGTCCGGCGTAGAGGATCGAGATCTCGATCCCGCGAAATTAATACGACTCACTATAG
CGGTCATTCGAAGCCAGTGCGAACCCTGACGGTATCCGACCGGGCCACTACGGCCGTGCTACGCAGGCCATCCGGTGCTATCCTAGAGCTAGGGCGCTTTAATTATGCTGAGTGATATC
        10        20        30        40        50        60        70        80        90       100       110       120
                                                                                  M  A  E  E  S  D  N  V  D  S  A  D  A  E  E  D  D  S  D  V
GGAGACCAACAACGGTTCCCTCTAGAAATAATTTTGTTTAACTTTAAGAAGGAGATATACCATGGCAGAAGAATCAGATAATGTACAGATAGTGCAGATGCAGAAGAAGATGATTCGGATGT
CCTCTGGTTGTTGCCAAGGGAGATCTTTATTAAAACAAATTGAAATTCTTCCTCTATATGGTACCGTCTTCTTAGTCTATTACATGTCTATCAGTCTACGTCTTCTTCTACTAAGCCTACA
          130       140       150       160       170       180       190       200       210       220       230       240
                 10                                              30                                       50
 M  A  E  E  E  V  A  E  V  E  E  E  E  A  D  D  E  D  D
 W  G  G  A  D  T  D  Y  A  D  G  S  E  D  K  V  V  E  V  A  E  E  E  V  A  E  V  E  E  E  E  A  D  D  E  D  D
ATGGTGGGGGGGTCAGATACCGATTACGCCGACGGTTCCGAAGATAAAGTGGTAGAAGTCGCAGAGAGGAAGAGGAAGTTGAGGAGGAAGCCGATGACGATGAGGATGA
TACCACCCCCCAGTCTATGGCTAATGCGGCTGCCAAGGCTTCTATTTCACCATCTTCAGCGTCTCCAACTCCTCCTTCGGCTACTGCTACTCCTACT
          250       260       270       280       290       300       310       320       330       340       350       360
          70                                           90
 E  D  G  D  E  V  E  E  E  A  E  E  P  Y  E  E  A  T  E  R  T  T  S  I  A  T  T  T  T  T  E  S  V  E  E  V  L  E
TGAGGACGGTGACGAAGTCGAAGAAGAGGCCCGAGAGCCCTACGAGGAGCCTACTGAACGGACGACAACTTCCATTGCCACGACCACCACAACTGAATCAGTAGAAGAAGTATTAGA
ACTCCTGCCACTGCTTCAGCTTCTTCTCCGGCTCCTCGATGCTCTCCGCATGCCTCGTTGAAGGTAACGGTGCTGGTGTTGACTTAGTCATCTTCATAATCT
          370       380       390       400       410       420       430       440       450       460       470       480
                   110                                       130
 V  L  F  Q  G  P  G  G  D  T  I  K  V  G  I  L  H  S  L  S  G  T  M  A  I  S  E  K  S  V  V  D  A  T  Q  L  A  I  E  Q
AGTATTATTCCAAGGCCCAGGCGGCGACCAACAATTAAAGTAGGTATCTTGCATTCCCTTAGTGGTACCATGGCCATCGAGAAAAGCGTAGTAGACGGACACAGTTAGCGATCGAACA
TCATAATAAGGTTCCGGGTTCCCGGGTCGGTCCGCCGCTGTGTTAATTTCATCCATAGAACGTAAGGAATCACCATGGTACGGAGTCTCTTTTCGCATCATCTGCGCTGTGTCAATCGCTAGCTTGT
          490       500       510       520       530       540       550       560       570       580       590       600
                              150                                      170
 I  N  Q  A  G  G  V  L  G  K  Q  I  Q  P  I  L  E  D  G  A  S  D  W  P  T  F  A  E  K  A  T  K  L  I  D  Q  D  K  V  V
AATTAATACAGGCCGGTGGCGTACTCGGCAAGCAGATCCAGCCTATCTTGGAAGACGGGGCATCGGACTGGCCAACCTTCGCTGAAAAAGCCACGAAATTAATCGATCAGGATAAAGTAGT
TTAATTATGTCCGGCCACCGCATGAGCCGTTCGTCTAGGTCGGATAGAACCTTCTGCCCGTAGCCTGACCGGTTGGAAGCGACTTTTTCGGTGCTTTAATTAGCTAGTCCTATTTCATCA
          610       620       630       640       650       660       670       680       690       700       710       720
                            190                                       210
 A  V  F  G  A  W  T  S  A  S  R  R  K  A  V  L  P  V  F  F  E  S  K  N  H  M  L  W  Y  P  V  Q  Y  E  G  Q  E  A  S  K  N  I
CGCAGTCTTCGGGGCATGGACATCGCATTCTCGTAAGGCAGTAGCTCCCGGTACTCCTAGGCAGTAGCATTCCGTAAGGAGCATTCCGTAAGCAGTGCATCCATCCGGGAAGAAGCTTCCAAGAATAT
GCGTCAGAAGCCCCGTACCGTAGGCGAAGAGCATTCCGTAGGCAGTAGCATTCCGTAGGCAGTAGCATTCCGTAGGGCCAGGTCATGCCTACCATGGGCCTCCGGTTCTTCGGAAGGTTCTTATA
          730       740       750       760       770       780       790       800       810       820       830       840
                       230                                        250
 F  Y  T  G  A  A  P  N  Q  Q  I  E  P  A  V  D  W  L  L  Q  N  K  G  K  K  F  F  L  V  G  S  D  Y  V  F  P  R  T  A  N
CTTCTATACCGGCGGCCGCCCCAAATCAGCAAATCGAACCGGCGGTGACTGCTCCTGCAGAATAAAGTAAAAAAGTTCTTTCTGATTACGTCTTCCCACGGACAGCAAA
GAAGATATGGCCCCGGCGGCGGGTTAGTCGTTAGCTTGGCCGCCGCACCTGACCGAGGACGTCTTATTTCAAGAAAGACATCACTAATGACAAGGGTGCCTGTCGTTT
          850       860       870       880       890       900       910       920       930       940       950       960
```

```
        T  I  I  K  A  Q  L  A  A  K  G  G  E  T  V  G  E  D  Y  L  P  L  G  N  T  E  V  T  P  I  I  T  R  I  R  N  A  L  P  D
        CACAATTATTAAAGCACAGCTCGCAGCAAAAGGGGCGAAACAGTTGGCGAAGATTATTACCACTCGGTAACACCGAAGTCACACCGATCATCACCGAGATTCGTAACGCCTCCCAGA
        GTGTTAATAATTTCGTGTCGAGCGTCGTTTTCCCCGCTTTGTCAACAGCGTCTAATAATGGTGAGCCATTGTGGCTTAGTGCCTAGTAGTGGCCTAAGCAATTGGGGAGGTCT
            970        980        990       1000       1010       1020       1030       1040       1050       1060       1070       1080

G  G  V  I  F  N  T  L  N  G  D  S  N  V  A  F  F  K  Q  L  Q  G  A  G  L  T  P  D  K  Y  P  T  M  S  V  S  I  A  E  E
        CGGTGGGGTAATCTTTAACACTCTCAATGGCGACTCGAACGTAGCTTTTTTTAAGCAATTGCAAGGTGCCGGTTTAACGCCAGACAATACCCTACCATGAGCGTCTCAATGCAGAGGA
        GCCACCCCATTAGAATTGTGAGAGTTACCGCTGAGCTTGCATCGAAAAAATTCGTTAACGTTCCACGGCGCAAATTGCGGTCTGTTTATGGATGGTACTCGCAGAGTTAACGTCTCCT
           1090       1100       1110       1120       1130       1140       1150       1160       1170       1180       1190       1200

E  V  Q  A  I  G  V  E  Y  L  K  G  H  Y  A  A  W  N  Y  F  M  T  V  D  T  P  E  N  K  S  F  V  E  A  F  K  A  K  F  G
        GGAGGTACAGGCTATCGGGGTCGAATACTTGAAGGGTCACTACGCCGCTTGGAACTACTTCATGACGGTTGACACCCCAGAAAACAAATCTTTTGTAGAGGCCTTCAAGGCGAAATTGG
        CCTCCATGTCCGATAGCCCCAGCTTATGAACTTCCCAGTGATGCGGCGAACCTTGATGAAGTACTGCCAACTGTGGGGTCTTTTGTTTAGAAACATCTCCGGAAGTTCCGCTTTAAACC
           1210       1220       1230       1240       1250       1260       1270       1280       1290       1300       1310       1320

Q  N  R  V  T  N  D  P  M  E  A  A  Y  I  A  V  H  L  W  K  Q  A  V  E  Q  A  G  T  A  D  D  L  E  K  V  R  Q  A  A  I
        TCAAAATCGTGTGACAAACGATCATGGAAGCAGCCTACATCGCCGTACACTTATGGAAACAAGCAGTTGAACAAGCAGGACCGGCGATGATCGGAGAAAGTCGGCAAGCAGCAAT
        AGTTTTAGCACACTGTTGCTAGTTGCTAGTTGCGATGTAGCCGCATGGATAGTAGCATTGTTCGTCAACTCGTTTGTCAACTTCGTCAACCTTCGAATACATTTTGTTCGTCCAGATCCTCTTGTCGAGGCCAAGCAGGCATTGTCGCCGGTTCGTCGTTA
           1330       1340       1350       1360       1370       1380       1390       1400       1410       1420       1430       1440

G  Q  T  F  N  A  P  E  G  P  V  K  M  F  A  N  H  H  I  S  K  T  V  R  I  G  E  V  G  E  D  G  L  F  K  I  V  Y  S  T
        TGGCCAGACCTTTAACGCGCCAGAGGGCCCAGTCAAGATGTTTGCAAATCACCATATTAGTAAAACAGTACGGATCGGCGAGGTAGGCGAGGATGGGCTCTTCAAGATTGTATACTCCAC
        ACCGGTCTGGAAATTGCCGCGGTCTCCCCGGGTCAGTTCTACAAACGTTTAGTGGTATAATCATTTTGTCATGCCTAGCGCTCCTACCCGAGAAGTTCTAACATATGAGGTG
           1450       1460       1470       1480       1490       1500       1510       1520       1530       1540       1550       1560

P  Q  P  V  D  P  L  P  W  N  Q  F  V  A  E  T  K  G  F  A  A  D  W  T  R  T  D  V  D  N  P  G  K  F  K  A  A  G  A  G
        ACCACAACCGGTAGACCCGATCCCACTGCCTTGGAACCAATTCGTTCGAGAACAAAGGCTTCGCCGCCGACTGACACGTAGACACGTGCATGCTGACCTGTGCATCGTTAGGCCATCGTTAAGTTCCGTCGCCCACGACC
        TGGTGTTGGCCATCTGGGGTGACGGTGAACCTTGGTTAAGCAACGTTGTTAAGCAAGCTTGAGCAAGCTCTAGGATCACCTAGGCCGTAAGCAATAACTTCCGGAAGCAACCGACCGACTTCAAGTTCCGTCGCCGTCGCCCACGACC
           1570       1580       1590       1600       1610       1620       1630       1640       1650       1660       1670       1680

G  S  H  H  H  H  H  H  *  *
        CGGTAGTCATCATCATCATCATTAATGAAAGGGCGATATCCAGCACACTGGCGGCCCGTTACTAGTGGATCCGGCTGCTAACAAAGCCCGAAAGGAAGCTGAGTTGGCTGCTGCCACC
        GCCATCAGTAGTAGTAGTAGTAGTAATTACTTTCCCGCTATAGGTCGTGTGACCGCCGGGCAATGATCACCTAGGCCGACGATTGTTTCGGGCTTCCTTCGACTCAACGACGACGGTGG
           1690       1700       1710       1720       1730       1740       1750       1760       1770       1780       1790       1800

GCTGAGCAATAACTAGCATAAACCCCTTGGGGCCTCTAAACGGGTCTTGAGGGGTTTTTTTGCTGAAAGGAGGAACTATATCCGGAGCGACTCCCACGGCACGTTGGCAAGCTCGGAATTCG
        CGACTCGTTATTGATCGTATTGGGGAACCCCGGAGAGATTTGCCCAAGAACTTGCCCAAAAACGACTTTCCTCCTTGATATAGGCCTCGCTGAGGGTGCCGTGCAACCGTTGAGCCTTAAGC
           1810       1820       1830       1840       1850       1860       1870       1880       1890       1900       1910       1920

FIG. 27 (Continued)
```

GCGTAATC
CGCATTAG

FIG. 27 (Continued)

FIG. 28 - Exemplary Expression Construct for csUBP7_26C

```
CGGTCACGCGCTTGGGACTGCCATAGGCTCGGCCCGGTGATGCGGCCCACGATGCGTCCGGCGGTAGAGGATCTGAGATCTCGATCCCGCGAAATTAATACGACTCACTATAGGGAGACCACAAC
GCCAGTGCGAACCCTGACGGTATCCGACCGGGCCACTACGGCGCCGGTGCTACGGCCATCTCCTAGCTCCTAGAGCTAGGCGCTTTAATTATGCTGAGTGATATCCCTCGTGTTG
         10        20        30        40        50        60        70        80        90       100       110       120
                                                                                         M  S  S  S  E  K  E  K  S  E  E  T  I  K  V  G  I  L  H  S  L  S
GGTTTCCCTCTAGAAATAATTTTGTTATTTAAGAAGGAGATATACCATGAGTTCATCAGAATCAGAAGAGAAAAAGTGAAGAGACCATCAAAGTAGGGATTCTCCACAGCTTGAG
CCAAAGGAGATCTTATTAAACAAATTGAAATTCTTCCTCTATATGGTACTCAAGTAGTCTTAGTCTTCTTTTTCACTTCTCTGTAGTTCATCCCTAAGAGGTGTCGAACTC
        130       140       150       160       170       180       190       200       210       220       230       240
                              30                                 40                                 50                                 60
 G  C  M  S  I  S  E  V  S  L  K  D  A  E  L  M  A  I  E  E  I  N  N  N  G  G  V  L  G  K  K  L  E  P  I  V  E  D  G  A
TGGTTGTATGTCAATCTCAGAAGTTCCTTAAAGATGCCGAATTGATGGCGATCGAAGAGATCAACAATAATGGCGGTGTGTTAGGTAAAAAGTTAGAACCGATCGTGGAAGATGGCGC
ACCAACATACAGTTAGAGTCTTCAAGGAATTTCTACGGCTTAACTACCGCTAGCTTCTCTAGTTGTTATTACCGCCACACAATCCATTTTCAATCTTGGCTAGCACTTCTACCGCG
        250       260       270       280       290       300       310       320       330       340       350       360
                              70                                 80                                 90                                100
 S  D  W  P  T  F  A  E  K  A  K  K  L  L  Q  K  D  K  V  A  V  I  F  G  A  W  T  S  A  S  R  K  A  V  L  P  V  V  E  E
CTCAGACTGGCCGACCTTCGCTGAAAAGCTAAGAAGCTTTTACAGAAGGACTAAGAAACTTTGAAATGTCTTCCTGTTCCACCGTCATTAAAAGCCCGAACCTGAGCGTTCAGCGTCAGCAGCTTCT
GAGTCTGACCGGCTGGAACGACTTTCGATTCTTCGAAATAGTCTTCCTGATTGAAAGGACAAGGTGGCAGTAATTTCGGCGCCCACGAGCCGTTCGCAGCCGTTTCGGCAGCGACGTCGGCGACCCGTCGCTCGACGACTTCGA
        370       380       390       400       410       420       430       440       450       460       470       480
                             110                                120                                130                                140
 N  N  G  L  L  F  Y  P  V  Q  Y  E  G  L  E  S  S  P  N  I  F  Y  M  G  A  A  P  N  Q  Q  I  V  P  A  V  K  W  L  F  D
AAATAATGGGCTTCTCTTCATCCGGTTCAGTATGCAGAAGGTCTCGAATGAAGTTCCCAAATAAGTTCTTTACATGGGGCGCCGCCCAAAACCAGCAGATCGTGCCAGCAGTTAAATGGCTCTTCGA
TTTATTACCGCGAAGAGAAGATAGGCCAGTGCATACTTCCGAGAGTTACTTCAGAGCTTACATCATACGTCGTTCAAGGGTTTATAGAAATGTACCCCGGCGGCGGGTTTTGGTCGTCTAGCACGGTCGTCAATTACCGAGAAGCT
        490       500       510       520       530       540       550       560       570       580       590       600
                             150                                160                                170                                180
 N  G  K  K  R  F  Y  L  L  G  S  D  Y  V  F  P  R  T  A  N  K  I  I  K  A  Y  L  K  Y  L  G  G  V  V  V  G  E  E  Y  T
CAACGGTAAGAAGCGTTTCTACCTCTTGGGCTCGGATTATGTATTCCCACGCACAGCAAACAAGATTATTAAGGCATAACTCAAATACCTCGGCGGTGTGTAGTAGTGAAGAATACAC
GTTGCCATTCTTCGCAAAGATGGAGAACCCGAGCCTAATACATAAGGGTGCGTGTCGTTTGTTCTAATAATTCCGTATGAGTCTATGGAGCCGCCACACATCATCCACTCTTATGTG
        610       620       630       640       650       660       670       680       690       700       710       720
                             190                                200                                210                                220
 P  L  G  H  T  D  Y  S  S  V  I  N  K  I  K  A  A  K  P  D  V  V  F  N  T  L  N  G  D  S  N  V  A  F  F  K  Q  L  K  D
CCCACTCGGTCGACACTGACTATAGTTCTGTCATTAATAAAATCAAAGCCCGACAAGCTCGTATTAACACTCTGAACGGGGATAGTAACTCTGAACTGTGAGACTTGCCCCTATCATTACATCGAAAATGTCGTTAATTCCT
GGGTGAGCCAGTGAGTGACTGATAATCAAGACAGTAATTATTTTAGTTCGGCGTTTCGCGTCTGCAGCATAAATGTGAGACTTGACACTTGCCTAACATTGAAAAAGTTCGTTAATTCCT
        730       740       750       760       770       780       790       800       810       820       830       840
                             230                                240                                250                                260
 A  G  I  D  A  N  T  L  P  V  M  S  V  S  I  A  E  E  E  I  K  G  I  G  P  E  Y  L  K  G  H  L  V  T  W  N  Y  F  Q  S
TGCCCGGGATTGACGCAAATACACTCCCTGTCATGAGCGTGAGCATCCGCGAGGAGATCAAAGGCATTGGTCCAGAGTATTTAAAAGGTCATCTGGTCACATGAACTATTTCCAAAG
ACGGGCCCTAACTGCGTTTATGTGAGGGACAGTACTCGCCACTCGTAGGCGCTCCCTCCTCTAGTTCCGTAACCCAGTCTCAATAAATTTTCCAGTAGACCAGTGTACCTTGATAAAGGTTC
        850       860       870       880       890       900       910       920       930       940       950       960
```

```
         270             280             290             300
  V  D  T  P  E  N  K  E  F  V  E  K  Y  K  K  K  Y  G  E  D  R  V  T  D  D  P  I  E  A  A  Y  I  G  V  Y  L  W  A  K  A
TGTAGATACACCGGAAAACAAGGAGTTCGTTGAGAAATATAAGAAAAAGTATGGGAGGACCGGGTGACAGATGACCCAATCGAGGCGGCATACATCGGCGTATACTTATGGGCTAAAGC
ACATCTATGTGGCCTTTTGTCCTCAAGCAACTCTTTATATTCTTTTTGAGAATTGGCCTCGGCCACTGTCTACTGGGTTAGCTGCCGCGTATGCCGCATAGCCCGCATGAATACCCGATTCG
  970       980       990       1000      1010      1020      1030      1040      1050      1060      1070      1080
               310             320             330             340
  V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACAGACGTGGATAAGGTCCGGGAGGCCGCGAAGGGCATCGAATTTAACGCCCCAGAGGGCTCCCAGTAAAGATTGACGGCGACCAGCACCTCTACAAGAC
CCAACTCTTCCGCCCCAGCTGTCTGCACCTATTCCAGGCCCTCCGGCGCTTCCCCGAGTTAAATTGCGGGGTCATTTCTAACTGCCGCTGTTGGTCGTGGTCGTGAGATGTTCTG
  1090      1100      1110      1120      1130      1140      1150      1160      1170      1180      1190      1200
               350             360             370             380
  V  R  I  G  E  I  L  E  N  G  Q  I  R  E  L  W  K  T  N  K  P  V  K  P  D  P  Y  L  K  G  Y  E  W  A  Q  G  L  S  E  Q
GGTGCGTATTGGTGAGATCCTGGAGAACGGTCAAATTCGTGAGTTGTGGAAAACAGTTAAACCAGATGATCCATATTTAAAAGGTTATGAATGGGCACAGGGTTAAGCGAGCA
CCACGCATAACCACTCTAGGACCTCTTGCCAGTTTAAGCACTCAACACTCTTTGTTTATTGGTCTAGGTATAAATTTTCCAATACTTACCCGTGTCCCCAATTCGCTCGT
  1210      1220      1230      1240      1250      1260      1270      1280      1290      1300      1310      1320
               390
  G  G  S  H  H  H  H  H  H  *  *  *
AGGTGGTTCACATCATCATCATCATTAATGAAAAGGGCGATATCAGCACACTGCCGCGGCCCGTTACTAGTGGATCCGGCTGCTAACAAAGCCCGAAAGGAAGCTGAGTTGGCTGCTGCC
TCCACCAAGTGGTAGTAGTAGTAGTAGTAATTACTTTCCCGCTATAGTCGTGTGACGGCCGGGGCAATGATCACCTAGGCCGACGATTGTTTCGGCTTTCGGCGATTGTTCGACTCAACCGACGACGG
  1330      1340      1350      1360      1370      1380      1390      1400      1410      1420      1430      1440

ACCGCTGAGCAATAACTAGCATAACCCCTTGGGCCTCTAAACGGTTCTTGAGGGTTTTTTGCTGAAAGGAGGAACTATATCCGGAGCGACTCCCACGGCACGTTGCCAAGCTCG
TGGCCGACTCGTTATTGATCGTATTGGGGAACCCCGGAGATTTGCCCAGAACTTCCTCCTTGATATAGGCCTCGCTGAGGGTGCCGTGCAACCGTTCGAGC
  1450      1460      1470      1480      1490      1500      1510      1520      1530      1540      1550
```

FIG. 28 (Continued)

FIG. 29 - Exemplary Expression Construct for csUBP7_27C

```
          270                    280                    290
Y  F  Q  S  V  D  T  P  E  N  K  E  F  V  E  K  Y  K  K  K  Y  G  E  D  R  V  T  D  D  P  I  E  A  A  Y  I  G  V  Y  L
CTATTTCCAAAGTGTAGATAGACACCGGAGAAAACAAGGAGTTCGTTGAGAAATATAAGAAAAAGTATGGGGAGGACCGGGTGACAGATGACCCAATCGAGGCGGCATACATCGGCGTATACTT
GATAAAGGTTTCACATCTATGTGGCCTTTTGTTCCTCAAGCAACTCTTTATATTCTTTTTCATACCCCTCTGCCACTGTCTACTGGGTTAGCTCCGCCGTATGTAGCCGCATATGAA
     970             980             990            1000            1010            1020            1030            1040            1050            1060            1070            1080

310                    320                    330
W  A  K  A  V  E  K  A  G  S  T  D  V  D  K  V  R  E  A  A  K  G  I  E  F  N  A  P  E  G  P  V  K  I  D  G  D  N  Q  H
ATGGGCTAAAGCGGTTGAGAAGGCGGGTCGACAGAGTCGGATAAGTCCGGAGGAGGCCGGCATCGAATTTAACGCCCAGAGGGCCCAGTAAAGATTGACGGCGACAACCAGCA
TACCCGATTTCGCCAACTCTTCCGCCCAGCTGTCTGCCACCTATTCCAGGCCTCCTCCGGTCTCATTTCTAACTGCCGCTGTTGGTCGT
    1090            1100            1110            1120            1130            1140            1150            1160            1170            1180            1190            1200

350                    360                    370
L  Y  K  T  V  R  I  G  E  I  L  E  N  G  Q  I  R  E  L  W  K  T  N  K  P  V  K  P  D  P  Y  L  K  G  Y  E  W  A  Q  G
CCTCTACAGACGGGTCGTATTGGTAGGAGATCCTGAGTTGTGGAAAACAAATAAACCAGTAAACCAGATCCATATTTAAAAGGTTATGAATGGGCACAGG
GGAGATGTTCGCCACGCCATAACCTAGGACCCTTCGCCAGTTAAGCACTCAACACCTTTTGTTATTTTGGTCAATTTGGTCTAGGTATAAATTTCCAATACTACCCGTCCC
    1210            1220            1230            1240            1250            1260            1270            1280            1290            1300            1310            1320

390
L  S  E  Q  G  G  S  H  H  H  H  H  *  *
GTTAAGCAGCAAGGTGTTCACATGTCCACTCATCATCATCATTAATGAAAGGCCGATATCCAGCACTGGCGCCGTTACTAGTGGATCCGGCTGCTAACAAAGCCCGAAAGGAAGCTGAG
CAATTCGCTCGTTCCACCAAGTGTAGTAGTAGTAGTAATTACTTTCCCGCTATAGGTCCGACCGCGCCGCAATGATCGATGATCACCTAGCCGACGATTGTTCGGCTTCCTTCCTTCGACTC
    1330            1340            1350            1360            1370            1380            1390            1400            1410            1420            1430            1440

TTGGCTGCTGCCACCGCTGACCAATAACTAGCATAACCCCTTGGGGCCTCTAAACGGGTCTTGAGGGTTTTTTGCTGAAAGGAGGAACTATATCCGGAGCGACTCCCACGGCACGTTGG
AACCGACGACGGTGGCGACTCGTTATTGATCGATCGATTTGCCCAGAACTCCCAGAGAATTTGCCAGAGACTTTCCTCCTTGATATAGGCCTCGCTGAGGTGCCGTGCAACC
    1450            1460            1470            1480            1490            1500            1510            1520            1530            1540            1550            1560

CAAGCTCGGAATTCGGCGTAATC
GTTCGAGCCTTAAGCCGCATTAG
    1570            1580

FIG. 29 (Continued)
```

FIG. 30 - Exemplary Expression Construct for csUBP7_30C

```
          270                280                   290
Y  F  Q  S  V  D  T  P  E  N  K  E  F  V  E  K  Y  K  K  K  Y  G  E  D  R  V  T  D  D  P  I  E  A  A  Y  I  G  V  Y  L
CTATTTCCAAAGTGTAGATACACCGGAAAACAAGGAGTTCGTTGAGAAATATAAGAAAAAAGTATGGGGAGGAAGATGACCGGTGACAGATGACCAATCGAGGCGGCATACATCGGCGTATACTT
GATAAAGGTTTCACATCTATGTGGCCTTTTGTTCCTCAAGCAACTCTTTATATTCTTTTTCATACCCCTCTGCCCACTGTCTACTGGGTTAGCTCCGCCGTATGTAGCCGCGCATATGAA
      970        980        990       1000       1010       1020       1030       1040       1050       1060       1070       1080

310                       320                          330
W  A  K  A  V  E  K  A  G  S  T  D  V  D  K  V  R  E  A  A  K  G  I  E  F  N  A  P  E  G  P  V  K  I  D  G  D  N  Q  H
ATGGGCTAAAGCGGTTGAGAAGGCGGGTCGACAGACGTGGATAAGTCCGGAGAGGCATCGAATTTAACGCCCAGAGGGCCCAGTAAAGATTGACGGCGACAACCAGCA
TACCCGATTTCGCCAACTCTTCCGCGCCAGCTGTCTGCACCTATTCCAGGCCTCTCCGGGTCTCATTTCTAACTGCCTGTTGGTCGT
     1090       1100       1110       1120       1130       1140       1150       1160       1170       1180       1190       1200

350                       360                          370
L  Y  K  T  V  R  I  G  E  I  L  E  N  G  Q  I  R  E  L  W  K  T  N  K  P  V  K  P  D  P  Y  L  K  G  Y  E  W  A  Q  G
CCTCTACAGACGGTGCGTATTGGTGGAGATCCTGAGTTGGTGGAGAACGGTCAAATTCGTGAGTTGTGGAAAACAAATAAACCAGTAAACCAGATCCATATTTAAAAGGTTATGAATGGGCACAGG
GGAGATGTCTGCCACGCAGGTAACACTCTAGGACCTTGCCAGTTAAGCACTCAACACCTTTTGTTTATTTGGTCAATTTGGTCTAGTATAAATTTCCAATACTACCCGTGTCCC
     1210       1220       1230       1240       1250       1260       1270       1280       1290       1300       1310       1320

390
L  S  E  Q  G  G  S  H  H  H  H  H  H  *  *
GTTAAGCGCAAGGTCGTTCACATCATGTTCACATCATCATCATTAATGAAAGGCGATATCCAGCACTGGCGCCGTTACTAGTGGATCCGGCTGCTAACAAAGCCCGAAAGGAAGCTGAG
CAATTCGCTCGTTCCACCAAGTGTAGTAGTAGTAGTAGTAATTACTTTCCCGCTATAGGTCGTGTGACCGCCGCAATGATCACCTAGGCCGACGATTGTTCGGCCTTCCTTCGACTC
     1330       1340       1350       1360       1370       1380       1390       1400       1410       1420       1430       1440

TTGGCTGCTGCCACCGCTGACCAATAACTAGCATAACCCCTTGGGCCTCTAAACGGGTCTTGAGGGGTTTTTTGCTGAAAGGAGGAACTATATCCGAGCGGACTCCCACGGCACGTTGG
AACCGACGACGGTGGCGACTCGTTATTGATCGTATTCGTATCGTATTGGGAACCCCGGAGATTTGCCCAGAACTCCCAAAAAACGACTTTCCTCCTTGATATAGGCCTGCTGAGGGTGCCGTGCAACC
     1450       1460       1470       1480       1490       1500       1510       1520       1530       1540       1550       1560

CAAGCTCGGAATTCGGCGTAATC
GTTCGAGCCTTAAGCCGCATTAG
     1570       1580

FIG. 30 (Continued)
```

FIG. 31 - Exemplary Expression Construct for csUBP7_65C

```
GCCAGTAAGCTTCGGTCACGCTTGGGACTGCCATAGCTGGCCCGGTGATGCCGCCACGATGCGTCGGCGGTAGAGGATCGAGATCTCGATCCGCGGTAGAGAATTAATACGACTCACTATAG
        10        20        30        40        50        60        70        80        90       100       110       120
CGGTCATTCGAAGCCAGTGCAGTATCCGACCGGGCACTACGGCCGTGCTACGCAGGCCCATCCTCTAGAGCTAGGGCGCTTTAATTATGCTGAGTGATATC
       130       140       150       160       170       180       190       200       210       220       230       240
                                                            M   S   S   S   E   K   K   S   E   E   T   I   K   V   G   I   L
                                                                                10
GGAGACCACAACGGTTCTCCCTCTAGAAATAATTTGTTAACTTTAAGAAGGAGATATACCATGAGTTCATCAGAATCAGAAAAAAGTGAAGAGACCATCAAAGTAGGGATTCT
       250       260       270       280       290       300       310       320       330       340       350       360
CCTCTGGTGTTGCCAAAGGAGATCTTATTAAACAATTGAAATTCTTCCTCATAGAGTCTTAGTCTTTTTCTTTTTCACTTCTCTGGTAGTTCATCCCTAAGA
       370       380       390       400       410       420       430       440       450       460       470       480
 H   S   L   S   G   T   M   S   I   S   E   V   S   L   K   D   A   E   L   M   A   I   E   E   I   N   N   N   G   G   V   L   G   K   K   L   E   P   I   V
                     30                                            40                                            50
CCACAGCTTGAGTGGTACGACATGTCAATCTCAGAAGTTTCCTTAAAAGATGCCGAATTAATGGCGATCGAAGAGATCAACAATAATGGCGGTGTTAGGTAAAAAGTTAGAACCGATCGT
       490       500       510       520       530       540       550       560       570       580       590       600
GGTGTCGAACTCACCATGCTACAGTTAGATCTTCAAAGGAATTTCTACGGCTTAATTAATGCCGCTAGCTTCTAGTTGTTATTACCGCCACAATCATTTTCAATCTTGGCTAGCA
       610       620       630       640       650       660       670       680       690       700       710       720
 E   D   G   A   C   D   W   P   T   F   A   E   K   K   A   K   K   L   L   Q   K   D   K   V   A   V   I   F   G   A   W   T   S   A   S   R   K   A   V   L   P
             70                                            80                                            90
GAAGATGGCGCCCTGTGACTGGCCGACCTTCGCTGAAAAGGCTAAGAAACTTTTACAGAAGGACAAAGTTGCAGTGATAATTTTCGGCGCTTGGACCTCGGCAAGTCGCAAAGCCCGTACTCCC
       730       740       750       760       770       780       790       800       810       820       830       840
CCTTCTACCGCGGACACTGACCGGCTGAAGCGACTTTCCGATTCTTTGAAAATGTCTTCCTGTTCCACCGTCATTAAAAGCCGCGAACCTGGAGCCGTTCAGCGTTTCGGCATGAGGG
       850       860       870       880       890       900       910       920       930       940       950       960
 V   V   E   E   N   N   G   L   L   F   Y   P   V   Q   Y   E   G   L   E   S   S   P   N   I   F   Y   M   G   A   A   P   N   Q   Q   I   V   P   A   V   K
                     110                                           120                                           130
AGTCGTCGAAGAAAATAATGGGCTTCTCTTCTATCCGGTTCAGTATGAAGGTCTCGAGAGTTCCCAAATATCTTTACATGGGCGCCGCCCCAAACCAGCAGATCGTGCCAGCAGTAA
TCAGCAGCTCTTCTTTATTACCCGAAGAGAAGATAGGCCAAGTCATACTTCAAGGGGTTATAGAAATGTACCCGCGGCGGTTTGGTCGTCTAGCACGGTCGTCATT
 W   L   F   D   N   G   K   K   R   F   Y   L   L   G   S   D   Y   V   F   P   R   T   A   N   K   I   I   K   A   Y   L   K   Y   L   G   G   V   V   V   G
         150                                           160                                           170
ATGGCTCTTCGACAACGGTAAGAACGTTTCTACCTCTTCGGATTATGTATTCCCACGCACAGCAAACAAGATTATTAAGGCATACTCAAATACCTCGGCGGTGTTGTAGTAGG
TACCGAGAAGCTGTTGCCATTCTTCGCAAAGATGGAGAACCCCTAATACATAAGGGTGCGTGTCGTTTGTTCTAATAATTCCGTATGAGTTTATGGAGCCGCCACAACATCATCC
 E   E   Y   T   P   L   G   H   T   D   Y   S   S   V   I   N   K   I   K   A   A   K   P   D   V   V   F   N   T   L   N   G   D   S   N   V   A   F   F   K
                     190                                           200                                           210
TGAAGAATACACCCCCACTCGGTCACACTGACTATAGTTCTGTCATTAATAAATCAAAGCCGCAGACGTCGTATTTAACACTCTGAACGGGATAATGAGCCTTTTCAA
ACTTCTTATGTGGGGTGAGCCAGTGTGACTGATATCAAGACAGTAATTATTTTAGTTCGGCGTTTCGGCGTTCTGCAGCCATAAATTGTGAGACTTGCCCATCATTACATCGGAAAAGTT
 Q   L   K   D   A   G   I   D   A   N   T   L   P   V   M   S   V   S   I   A   E   E   I   K   G   I   G   P   E   Y   L   K   G   H   L   V   T   W   N
             230                                           240                                           250
GCAATTAAAGGATGCCGGGATTGACGCAAATACACTCCCTGTCATGACGGTGAGCATCGCCGAGGAGGAGATCAAAGGCATTGGTCCAGAGTATTTAAAAGGTCATCTGGTCACATGGAA
CGTTAATTTCCTACGGCCCTAACTGCTGCGTTTATGTGAGGGACAGTACTCCGCACTCGTAGCGGCCTCCTCCTCTAGTTTCCGTACCAGTGTCATAAATTTCCAGTAGACCAGTGTACCTT
```

```
                                                                      270                                      280                                      290
              Y  F  Q  S  V  D  T  P  E  N  K  E  F  V  E  K  Y  K  K  K  Y  G  E  D  R  V  T  D  D  P  I  E  A  A  Y  I  G  V  Y  L
              CTATTTCCAAAGTGTAGATACACCGGAAAACAAGGAGTTCGTTGAGAAATATAAGAAAAAGTATGGGGAGGACCGGGTGACAGATGACCAATCGAGGCGGCATACATCGGCGTATACTT
              GATAAAGGTTTCACATCTATGTGGCCTTTTGTTCCTCAAGCAACTCTTTATATTCTTTTTCATACCCCTCCTGGCCCACTGTCTACTGGGTTAGCTCCGCCGTATGTAGCCGCATATGAA
                  970             980             990            1000            1010            1020            1030            1040            1050            1060            1070            1080
                                                                      310                                      320                                      330
              W  A  K  A  V  E  K  A  G  S  T  D  V  D  K  V  R  E  A  A  K  G  I  E  F  N  A  P  E  G  P  V  K  I  D  G  D  N  Q  H
              ATGGGCTAAAGCGGTTGAGAAGGCGGTCGACAGAGACGTGGATAAGGTCCGGGAGGCATCGAATTTAACGCCCCAGAGGGCCCAGTGAAGATTGACGGCGACAACCAGCA
              TACCCGATTTCGCCAACTCTTCCGCCAGCTGTCTGCACCTATTCGCAGCCTCTCGTAGCTTAAATTGCGGGGTCTCCGGGTCATTTCTAACTGCCGCTGTTGGTCGT
                 1090            1100            1110            1120            1130            1140            1150            1160            1170            1180            1190            1200
                                                                      350                                      360                                      370
              L  Y  K  T  V  R  I  G  E  I  L  E  N  G  Q  I  R  E  L  W  K  T  N  K  P  V  K  P  D  P  Y  L  K  G  Y  E  W  A  Q  G
              CCTCTACAAGACGGGTCGTATTGGTGAGATCCTGGAGAACGGTCAGTTGTGAGAAATTCGTAGTTGTGGAAAACAAATAAACCAGTAAACCAGATCCATATTTAAAAGGTTATGAATGGGCACAGG
              GGAGATGTTCTGCCACGCAATAACACTCTAGGACCCTTCCAGTTAAGCACTCAACACCTTTGTTATTTGGTCAATTTGGTCTAGGTATAAATTTTCCAATACTATAAATTTTCCAATACTACCCGTCTCCC
                 1210            1220            1230            1240            1250            1260            1270            1280            1290            1300            1310            1320
                                                                      390
              L  S  E  Q  G  G  S  H  H  H  H  H  H  *  *
              GTTAAGCGCAAGGTGGTTCACATCATCATCATCATCATTAATGAAAGGCCGATATCCAGCACACTGGCGCCGTTACTAGTGGATCCGGCTGCTCTAACAAAGCCCGAAAGGAAGCTGAG
              CAATTCGCTGCTCGTTCCACCAAGTGTAGTAGTAGTAGTAGTAATTACTTTCCGCGCTATAGGTCGTGTGACCGCCGCAATGATCACCTAGGCCGACGATTGTTCGGGCTTCCTTCGACTC
                 1330            1340            1350            1360            1370            1380            1390            1400            1410            1420            1430            1440

TTGGCTGCTGCCACCGCTGAGCAATAACTAGCATAACCCCTTTGGGGCCTCTAAACGGGTCTTGAGGGGTTTTTTGCTGAAAGAGGAACTATATCCGAGCGGACTCCCACGGCACGTTGG
              AACCGACGACGGTGGCGACTCGTTATTGATCGTATTGGGGGAAACCCCCGGAGAGTTTGCCCAGAACTCCCAGAAACGACTTTCCTCCTTGATATAGGCCCTGCGCTGAGGGTGCCGTGCAACC
                 1450            1460            1470            1480            1490            1500            1510            1520            1530            1540            1550            1560

CAAGCTCGGAATTCGGCGTAATC
              GTTCGAGCCTTAAGCCGCATTAG
                 1570            1580

FIG. 31 (Continued)
```

FIG. 32 - Exemplary Expression Construct for csUBP7_69C

```
            Y  F  Q  S  V  D  T  P  E  N  K  E  F  V  E  K  Y  K  K  Y  G  E  D  R  V  T  D  D  P  I  E  A  A  Y  I  G  V  Y  L
         CTATTTCCAAAGTGTAGATGTAGATACACCGGAAAACAAGGAGTTCGTTCGTTGAGAAATATAAGAAAAAGTATGGGGAGGAGATGACCGGGTGACAGATGACCAATCGAGGCGGCATAACATCGGCGTATACTT
         GATAAAGGTTTCACATCTATGTGGCCTTTTTGTTCCTCAAGCAACTCTTATATTCTTTTTCATACCCCTCTGGCCACTGTCTACTGGGTTAGCTCCGCCGTATGTAGCCGCATATGAA
            970        980        990        1000       1010       1020       1030       1040       1050       1060       1070       1080

W  A  K  A  V  E  K  A  G  S  T  D  V  D  K  V  R  E  A  A  K  G  I  E  F  N  A  P  E  G  P  V  K  I  D  G  D  N  Q  H
         ATGGGCTAAAGCGGTTGAGAAGCGGGTCGACAGACGTGGATAAGGTCCGGGAGGAGGCCGGCGAAGGCATCGAATTTAACGCCCCAGAGGGCCCAGTAAAGATTGACGGCGACAACCAGCA
         TACCCGATTTCGCCAACTCTTCCGCCGCTCTGCTGCACCTATTCCAGGCCCTCGCGCCTTCCGTAGCTTAAATTGCGGGGTCTCCGGGTCATTTCTAATTGCCGCTGTTGGTCGT
            1090       1100       1110       1120       1130       1140       1150       1160       1170       1180       1190       1200

L  Y  K  T  V  R  I  G  E  I  L  E  N  G  Q  I  R  E  L  W  K  T  N  K  P  V  K  P  D  P  Y  L  K  G  Y  E  W  A  Q  G
         CCTCTACAAGACGGTGCGTATTGGTGAGATCCTGGAGAACGGTCAAATTCGTGAGTTGTGGAAAACAAATAAACCAGTAAACCAGATCCATATTTAAAAGGTTATGAATGGGCACAGGG
         GGAGATGTTCTGCCACGCATAACACTCTAGGACCACTCTTGCCAGTTTAAGCACTCAACACCTTTGTTATTTGCTCAATTTGGTCATTGGTCTAGGTATAAATTTTCCAATACTACCCGTCCC
            1210       1220       1230       1240       1250       1260       1270       1280       1290       1300       1310       1320

L  S  E  Q  G  G  S  H  H  H  H  H  H  *  *
         GTTAAGCAGCAAGGTGGTTCACATCATCATCATCATCATTAATGAAAGGCCGATATCCAGCACTGGCCGGCCGTTACTAGTCGATCCGGCTGCTAACAAAGCCCGAAAGGAAGCTGAG
         CAATTCGCTGCTCGTTCCACCAAGTCTGTAGTAGTAGTAGTAGTAATTACTTTCCGCTATAGGTCGTGACCGGCCGGCAATGATCAGTCTAGGCCGACTAGCCGACGATTGTTCGGCTTCCTTCGACTC
            1330       1340       1350       1360       1370       1380       1390       1400       1410       1420       1430       1440

TTGGCTGCTGCTGCACCGCTGACACCGGCAATAACTAGCATAACCCCTTTGGGCCTCTAAACGGGTCTTGAGGGGTTTTTTGCTGAAAGAGGAACTATATCCGGAGCGGACTCCCACGGCACGTTGG
         AACCGACGACGACGTGGCGACTCGTTATTGATCGTATCAGCGTATTGGGAACCCCGGAGATTTGCCCAGAACTCCCAGAAACTCCTTGATATAGGCCTGCGCCTGAGGGTGCCGTGCAACC
            1450       1460       1470       1480       1490       1500       1510       1520       1530       1540       1550       1560

CAAGCTCGGAATTCGGCGTAATC
         GTTCGAGCCTTAAGCCGCATTAG
            1570       1580

FIG. 32 (Continued)
```

FIG. 33 - Exemplary Expression Construct for csUBP7_90C

```
      Y  F  Q  S  V  D  T  P  E  N  K  E  F  V  E  K  Y  K  K  K  Y  G  E  D  R  V  T  D  D  P  I  E  A  A  Y  I  G  V  Y  L
CTATTCCAAAGTGTAGATGACCGGAAAACAAGGAGTTCGTTGAGAAATATAAGAAAAAAGTATGGGAGGAGACCGGGTGACAGATGACCAATCGAGGCGGCATACATCGGCGTATACTT
GATAAAGGTTTCACATCTATGTGGCCTTTTGTTCCTCAAGCAACTTCTTTTTCATACCCCTCTGCCCACTGTCTACTGGGTTAGCTCCGCCGTATGTAGCCGCATATGAA
           970       980       990      1000      1010      1020      1030      1040      1050      1060      1070      1080
                                                              280                                  290
      W  A  K  A  V  E  K  A  G  S  T  D  V  D  K  V  R  E  A  A  K  G  I  E  F  N  A  P  E  G  P  V  K  I  D  G  D  N  Q  H
ATGGGCTAAAGCGGTTGAGAAGCGGGTCGACAGACGTGGATAAGTCCGGAGGAGGCATCGAATTTAACGCCCAGAGGGCCAGTAAAGATTGACGGCGACAACCAGCA
TACCCGATTTCGCCAACTCTTCGCCGCTCTGTCTGCCACCTATTCCAGGCCTCCGGGTCTCATTTCTAACTGCCGCTGTTGGTCGT
          1090      1100      1110      1120      1130      1140      1150      1160      1170      1180      1190      1200
                                                              320                                  330
      L  Y  K  T  V  R  I  G  E  I  L  E  N  G  Q  I  R  E  L  W  K  T  N  K  P  V  K  P  D  P  Y  L  K  G  Y  E  W  A  Q  G
CCTCTACAAGACGGTCGCTATTGGTGAGATCCTGGAGAACGGTCAGATTCGTGAGTTGTGAAAACAAATAAACCAGTAAACCAGATCCATATTTAAAAGTTATGAATGGGCACAGG
GGAGATGTTCGCCACGCAATAACCACTCTAGGACCCTTGCCAGTTAAGCACTCAACACCTTTTGTTATTTGGTCAATTTGTCTAGTATAAATTTCCAATACTACCCGTGTCCC
          1210      1220      1230      1240      1250      1260      1270      1280      1290      1300      1310      1320
                                                              360                                  370
      L  S  E  Q  G  G  S  H  H  H  H  H  H  *  *
GTTAAGCGCAAGGTGGTTCACATCATCATCATCATCATTAATGAAAGGCGATATCCAGCACTGGCGCCGTTACTAGTGGATCCGGCTGCTAACAAAGCCCGAAAGGAAGCTGAG
CAATTCGCCTCGTTCCACCAAGTGTAGTAGTAGTAGTAGTAATTACTTTCCGCTATAGGTCGTGACCGCCGCAATGATGATCCTAGGCCGACGATTGTTCGGCGTTCCTTCGACTC
          1330      1340      1350      1360      1370      1380      1390      1400      1410      1420      1430      1440
                        390
TTGGCTGCTGCCACCGCTGACGCAATAACTAGCATAACCCCTTGGGCCTCTAAACGGGTCTTGAGGGTTTTTTTGCTGAAAGGAGGAACTATATCCGAGCGGACTCCCACGGCACGTTGG
AACCGACGACGGTGGCGACTCGTTATTGATCGATCATTGGGAACCCCGGAGATTTGCCCAGAACTCCCAGAAACGACTTTCCTTCCTTGATATAGGCCTGCCTGAGGGTGCCGTGCAACC
          1450      1460      1470      1480      1490      1500      1510      1520      1530      1540      1550      1560

CAAGCTCGGAATTCGGCGTAATC
GTTCGAGCCTTAAGCCGCATTAG
          1570      1580

FIG. 33 (Continued)
```

FIG. 34 - Exemplary Expression Construct for csUBP7_92C

```
GCCAGTAAGCTTCGGTACGCTTGGGACTGCCATAGCTCTGGCCCGTGATGCCGCCACGATGCGTCCGGCGTAGAGGATCGAGATCTCGATCCCGCGGAAATTAATACGACTCACTATAG      120
CGGTCATTCGAAGCCATGCGAACCCTGACGGTATCCGACCGGGCACTACGGCCGTGCTACGCAGGCCGCATCCTCTAGAGCTAGGAGGCGCTTTAATTATGCTGAGTGATATC

M  S  S  S  E  K  K  S  E  E  T  I  K  V  G  I  L
                                                                       10
GGAGACCACAACGGTTCTTCCCTCTAGAAAATAATTTGTTAACTTTTAAGAAGGAGATATACCATGAGTTCATCAGAAATCAGAAAAAGTGAAGAGACCATCAAAGTAGGGATCT         240
CCTCTGGTGTTGCCAAAGAAGAGATCTTTATTAAACAATTGAAATTCTTCCTCTATATGGTACTCAAGTAGTCTTTAGTCTTTTTCTTTTTCACTTCTCTGGTAGTTCATCCCTAGA

H  S  L  S  G  T  M  S  I  S  E  V  S  L  K  D  A  E  L  M  A  I  E  E  I  N  N  N  G  G  V  L  G  K  K  L  E  P  I  V
                  30                                     40                                     50
CCACAGCTTGAGTGGTACGATGTCAATCTCAGAAGTTCCTTAAAAGATGCCGAATTAATGGCGATCGAAGAGATCAACAATAATGGCGGTGTGTTAGGTAAAAAGTTAGAACCGATCGT      360
GGTGTCGAACTCACCATGCTACAGTTAGATGTCTTCAAGGAATTTTCTACGGCTTAATTACCGCTAGCTTCTCTAGTTGTTATTACCGCCACACAATCATTTTCAATCTTGGCTAGCA

E  D  G  A  S  D  W  P  T  F  A  E  K  K  A  K  K  L  L  Q  K  D  K  V  A  V  I  F  G  A  W  T  C  A  S  R  K  A  V  L  P
                  70                                     80                                     90
GAAGATGGCGCCCTCAGACTGGCCGACCTTCGCTGAAAAGGCTAAGAAACTTTTACAGAAGGACAAGGTGGCAGTTATTTTCGGCGCTTGGACCTGCGCAAGTCGCAAAGCCCGTACTCCC  480
CTTCTACCGCGGAGTCTGACCGGCTGACGCGGAAGCGACTTTCCGATTCTTGAAAATGTCTTCCTGTTCCACCGTCAATAAAAGCCGCGAACCTGACGCGTTCGGCATGAGGG
                  370           380           390           400           410           420           430           440           450           460           470           480

V  V  E  E  N  N  G  L  L  F  Y  P  V  Q  Y  E  G  L  E  S  S  P  N  I  F  Y  M  G  A  A  P  N  Q  Q  I  V  P  A  V  K
                  110                                    120                                    130
AGTCGTCGAAGAAAATAATGGGCTTCTCTTCTATCCGGTTCAGTATGAAGGTCTCGAGAGTTCCCGAAAGTTCCCAAATATCTTTACATGGGCGCCGCCCCAACCAGCAGATCGTCCAGCAGTAA      600
TCAGCAGCTTCTTATTACCCGAAGAGAAGATAGGCCAAGTCATACTTCCAGAGCTCTCAAGGGGTTTCAATGAAAATGTACCCGCGGGGTTGGTCGTCTAGCACGGTCGTCAATT

W  L  F  D  N  G  K  K  R  F  Y  L  L  G  S  D  Y  Y  V  F  P  R  T  A  N  K  I  I  K  A  Y  L  K  Y  L  G  G  V  V  V  G
                  150                                    160                                    170
ATGGCTCTTCGACAACGGTTAAGAACGTTTCTACCTCTTGGGCTCGGATTATGTATTCCAACGCACAGCAACAAGATTATTAAGGCATACCTCAAATACCTCGGCGGTGTTGTAGTAGG      720
TACCGAGAAGCTGTTGCCAATTCTTCGCAAAGATGAGAACCCGAGCGCTAATACATACAAGTAAGGGTGCGTGTCGTTTGTCCGTATGAGTTTATGGAGCCGCCACAACATCATCC

E  E  Y  T  P  L  G  H  T  D  Y  S  S  V  I  N  K  I  K  A  A  K  P  D  V  V  F  N  T  L  N  G  D  S  N  V  A  F  F  K
                  190                                    200                                    210
TGAAGAATACACCCCACTCCGGTCACACTGATCACTATAGTTCTGTCATTAATAAATCAAAGCCGCAAAGCCAGACGTCGTATTTAACACTCTGAACGGGGATAGTAGCCTTTTTCAA      840
ACTTCTTATGTGGGGTGAGGCCAGTGTGACTAGTGATATCAAGACAGTAATTATTAGTTTCCGCGTTTCGGCGCATTGGCGCTCGAAGACTGCCTATCATCATTACATCCGGAAAAGTT

Q  L  K  D  A  G  I  D  A  N  T  L  P  V  M  S  V  S  I  A  E  E  I  K  G  I  G  P  E  Y  L  K  G  H  L  V  T  W  N
                  230                                    240                                    250
GCAATTAAAGGATGCCGGGATTGACGCAATACACTCCCTGTCATGAGCCGTGAGCATCGCCGAGGAGGAAATCAAAGGCATTGGTCCAGATGTATTAAAAGTCATCTGGTCACATGAA      960
CGTTAATTTCCTACGGCCCTAACTGCGTTATGTGAGGGACAGTACTCGGCACTCGTAGCGGCCTCCTCCTAGTTTCCGTAACCAGGTCTCATAAATTTCCAGTAGACCAGTGTACCTT
```

```
                    270               280                 290
     Y  F  Q  S  V  D  T  P  E  N  K  E  F  V  E  K  Y  K  K  Y  G  E  D  R  V  T  D  D  P  I  E  A  A  Y  I  G  V  Y  L
     CTATTTCCAAAGTGTAGATACACCGGAAAACAAGGAGTTCGTTGAGAAATATAAGAAAAAGTATGGGGAGGATGACCGGGGTGACAGATGACCAATCGAGGCGGCATACATCGGCGTATACTT
     GATAAAGGTTTCACATCTATGTGGCCTTTTGTTCCTCAAGCAACTCTTTATATTCTTTTTCATACCCCTCCTGCCCACTGTCTACTGGCCCCACTGTCTAGCTCCGCCGTATGTAGCCGCATATGAA
         970        980        990       1000       1010       1020       1030       1040       1050       1060       1070       1080

310                      320                     330
     W  A  K  A  V  E  K  A  G  S  T  D  V  D  K  V  R  E  A  A  K  G  I  E  F  N  A  P  E  G  P  V  K  I  D  G  D  N  Q  H
     ATGGGCTAAAGCGGTTGAGAAGGCGGGTCGACAGACGTGGATAAGGTCCGGGAGGAGGCATCGAATTTAACGCCAGAGGGCCCAGTAAAGATTGACGGCGACAACCAGCA
     TACCCGATTTCGCCAACTCTTCCGCCGCAGCTGTCTGCACCTATTCCAGGCGCTTCCGTAGCTTAAATTGCGGGTCTCCGGGTCATTTCTAACTGCCGCTGTTGGTCGT
        1090       1100       1110       1120       1130       1140       1150       1160       1170       1180       1190       1200

350                     360                      370
     L  Y  K  T  V  R  I  G  E  I  L  E  N  G  Q  I  R  E  L  W  K  T  N  K  P  V  K  P  D  P  Y  L  K  G  Y  E  W  A  Q  G
     CCTCTACAGAGACGGTCGCTATTGGTGAGATCCTGGAGAACGGTCAATTCGTAGTTGTGAAAACAAATAAACCAGTAAACCAGATCCATATTTAAAAGTTATGAATGGGCACAGG
     GGAGATGTCTGCCACGCAATAACACTCTAGGACCACTCTTGCCAGTTAAGCACTCAACACCTTTTGTTATTTGGTCAATTTGGTCAATTTCCAATACTAAATTTCCAATACTACCCGTGTCCC
        1210       1220       1230       1240       1250       1260       1270       1280       1290       1300       1310       1320

390
     L  S  E  Q  G  G  S  H  H  H  H  H  H  *  *
     GTTAAGCAGCAAGGTGGTTCACATCATCATCATCATCATTAATGAAAGGCGATATCCAGCACTGGCGCCGTTACTAGTGGATCCGGCTGCTAACAAAGCCCGAAAGGAAGCTGAG
     CAATTCGTCGTTCCACCAAGTGTAGTAGTAGTAGTAGTAATTACTTTCCGCTATAGGTCGTGACCGCCGGCAATGATCACCTAGGCCGACGATTGTTCGGCCTTCCTTGACTC
        1330       1340       1350       1360       1370       1380       1390       1400       1410       1420       1430       1440

TTGGCTGCTGCCACCGCTGAGCAATAACTAGCATAACCCCTTTGGGGCCTCTAAACGGGTCTTGAGGGGTTTTTTGCTGAAAGGAGGAACTATATCCGGAGCGGACTCCCACGGCACGTTGG
     AACCGACGACGGTGGCGACTCGTTATTGATCGTATTGGATCGGTATTCTATTTTATTTACTTAATTGGAAACCCGGAGATTTGCCCAAAAAACGACTTTCCTCCTTGATATAGGCCTCGCTGAGGTGCCGTCAACC
        1450       1460       1470       1480       1490       1500       1510       1520       1530       1540       1550       1560

CAAGCTCGGAATTCGGCGTAATC
     GTTCGAGCCTTAAGCCGCATTAG
        1570       1580

FIG. 34 (Continued)
```

FIG. 35 - Exemplary Expression Construct for csUBP7_92C

```
            270                  280                   290
Y  F  Q  S  V  D  T  P  E  N  K  E  F  V  E  K  Y  K  K  K  Y  G  E  D  R  V  T  D  D  P  I  E  A  A  Y  I  G  V  Y  L
CTATTTCCAAAGTGTAGATACACCGGAAAACAAGGAGTTCGTTGTTGAGAAATATAAGAAAAAAGTATGGGGAGGAGATGACCAATCGAGGCGGCATACATCGGCGTATACTT
GATAAAGGTTTCACATCTATGTGGCCTTTTGTTCCTCAAGCAACTCTTTATATTCTTTTTCATACCCCTCCTGCCCACTGCCTACTGGGTTAGCTCCGCCGTATGTAGCCGCATATGAA
   970        980        990       1000       1010       1020       1030       1040       1050       1060       1070       1080

310                  320                   330
W  A  K  A  V  E  K  A  G  S  T  D  V  D  K  V  R  E  A  A  K  G  I  E  F  N  A  P  E  G  P  V  K  I  D  G  D  N  Q  H
ATGGGCTAAAGCGGTTGAGAAGGCGGGTCGACAGACGTGGATAAGGTCCGGGAGGAGGCCATGCATCGAATTTAACGCCCAGAGGGCCCAGTAAAGATTGACGGCGACAACCAGCA
TACCCGATTTCGCCAACTCTTCCGCCCAGCTGTCTGCACCTATTCCAGGCCCTCTCCGGAGCGCTTCCGGGGTCTCCGGGTCATTTCTAACTGCCTGTTGGTCGT
  1090       1100       1110       1120       1130       1140       1150       1160       1170       1180       1190       1200

350                  360                   370
L  Y  K  T  V  R  I  G  E  I  L  E  N  G  Q  I  R  E  L  W  K  T  N  K  P  V  K  P  D  P  Y  L  K  G  Y  E  W  A  Q  G
CCTCTACAGACGGGTCGTATTGGTGGAGATCCTGGAGAACGGTCAGTTCGTGAGTTGTGAAAACAAATAAACCAGTAAACCAATATCCATCATATTTAAAAGGTTATGAATGGGCACAGG
GGAGATGTTCGCCACGCAATAACCACTCTAGGACCCTTCGCCAGTTAAGCACTCAACACCTTTTGTTATTTGGTCAATTTGGTCTAGTATAAATTTTCCAATACTAAATTTCCAATAACTACCCGTCCC
  1210       1220       1230       1240       1250       1260       1270       1280       1290       1300       1310       1320

390
L  S  E  Q  G  G  S  H  H  H  H  H  H  *  *
GTTAAGCAGCAAGGTGGTTCACATCATCATCATCATCATTAATGAAAGGCGATATCCAGCACTGGCGCCGTACTAGTGGATCCGGCTGCTAACAAAGCCCGAAAGGAAGCTGAG
CAATTCGCTCGTTCCACCAAGTGTAGTAGTAGTAGTAGTAATTACTTTCCCGCTATAGGTCGTGACCGCCAATGATCACCTAGGCCGACGATTGTTCGGCCTTCCTTCGACTC
  1330       1340       1350       1360       1370       1380       1390       1400       1410       1420       1430       1440

TTGGCTGCTGCTGCCACCGCTGCAATAACTAGCATAACCCCTTTGGGGCCTCTAAACGGGTTCTTTTTGCTGAAAGGAGAACTATATCCGAGCGGACTCCCACGGCACGTTGG
AACCGACGACGACGGTGGCGACTCGTTATTGATCGTATCGTATTGCCCAGAGAACTTCCCTTGATATAGGCCTGCTGGAGGGTGCCGTGCAACC
  1450       1460       1470       1480       1490       1500       1510       1520       1530       1540       1550       1560

CAAGCTCGGAATTCGGCGTAATC
GTTCGAGCCTTAAGCCGCATTAG
  1570       1580

FIG. 35 (Continued)
```

FIG. 36 - Exemplary Expression Construct for csUBP7_93C

```
GCCAGTAAGCTTCGGTGCACGCTTGGGACTGCCATAGGCTCCATGATGCCGCCCGGTGATGCCGCCACGATGGCTCCGGCGTAGAGGATCGAGATCTCGATCCCGCGAAATTAATACGACTCACTATAG
  10        20        30        40        50        60        70        80        90       100       110       120
CGGTCATTCGAAGCCAGTGCAGTCCCTGACGGTATCCGACGGTGCTACGGCCGACTCCTAGAGCTGCTAGGCGCTTTAATTATGTGAGTGATATC
GGAGACCACAACGGTTTCCCTCTAGAAATAATTTTGTTTAACTTTAAGAAGGAGATATACCATGAGTTCATCGAGTGAAAAGAAAAGTGAAGACCATCAAAGTAGGGATTCT
                                                                M  S  S  S  E  K  K  S  E  E  T  I  K  V  G  I  L
                                                                                   10
 130       140       150       160       170       180       190       200       210       220       230       240
CCTCTGGTGTTGCCAAAGGAGATCTTATTATTGAAAATCTTAAAACAAATTGAAATTCTTCCTCTATATGGTACTCAAGTAGTCTTTTCTTTTTTCACTTCTCTGGTAGTTCATCCCTAAGA
H  S  L  S  G  T  M  S  I  S  E  V  S  L  K  D  A  E  L  M  A  I  E  E  I  N  N  N  G  G  V  L  G  K  K  L  E  P  I  V
                          30                                        40                                        50
 250       260       270       280       290       300       310       320       330       340       350       360
CCACAGCTTGAGTGGTACGATGTCAATCTCAGAAGTTCCTTAAAAGATGCCGAATTAATGGCGATCGAAGATCAACATAATGGCGGTGTGTTAGGTAAAAAGTTAGAACCGATCGT
GGTGTCGAACTCACCATGCTACAGTTAGATCTTCAAAGGAATTTCTACGGCTTAATTCTAGTTGTTATTACCGCCACAATCATTTTCAATCTTGGCTAGCA
E  D  G  A  S  D  W  P  T  F  A  E  K  K  K  L  L  Q  K  D  K  V  A  V  I  F  G  A  W  T  S  C  S  R  K  A  V  L  P
           70                                         80                                         90
 370       380       390       400       410       420       430       440       450       460       470       480
GGAAGATGGCGCCCTCAGACTGGCCGACCTTCGCTGAAGACGCTAAGAAGCTAAGAAACTTTACAGAAGGACCAAGGTGGCAGTAATTTCGCGCTTGACCTCGTGCAGTCGCAAAGCCCGTACTCCC
CCTTCTACCCGCGGAGTCTGACCGGCTGGAAGCGACTTTTCCGATTCCTTGAAAATGTCTTCTCCTGTCATTAAAAGCCGCGAACCTGAGACTGCATGAGGG
V  V  E  E  N  N  G  L  L  F  Y  P  V  Q  Y  E  G  L  E  S  S  P  N  I  F  Y  M  G  A  A  P  N  Q  Q  I  V  P  A  V  K
                       110                                       120                                       130
 490       500       510       520       530       540       550       560       570       580       590       600
AGTCGTCGAAGAAAATAATGGGCTTCTCTTCTATCCGGTTCAGTATGGAAGGTCTCGAAAGTTCCCAAATATCTTTACATGGCGCCGCCCCAAACCAGCAGATCGTGCCAGCAGTTAA
TCAGCAGCTTCTTTATTACCCGAAGAGAAGATAGGCCAAGTCAATACTTCCAAGGGGTTTATGAAAATGTACCCGCGGTTGGTCGTCTAGCACGGTCGTCAATT
W  L  F  D  N  G  K  K  K  R  F  Y  L  L  G  S  D  Y  V  F  P  P  R  T  A  N  K  I  I  K  A  Y  L  K  Y  L  G  G  V  V  V  G
                       150                                       160                                       170
 610       620       630       640       650       660       670       680       690       700       710       720
ATGGCTCTTCGACAACGTGTAAGAAGCGTTTCTACCTCTTGGGCTCGGATTATGTATTCCCACGCACAGCACAAGATTATTAAGGCATACCTCAAATACCTCGGCGGTGTTGTAGTAGG
TACCGAGAAGCTGTTGCCATTCTTCGCAAGATGAGAACCCGAGCCTAATACATAAGGGTGCGTGTCGTTTGTTCTAATAATTCCGTATGGAGTTTATGGAGCCGCCACAACATCATCC
E  E  Y  T  P  L  G  H  T  D  Y  S  S  V  I  N  K  K  I  K  A  A  K  P  D  V  V  F  N  T  L  N  G  D  S  N  V  A  F  F  K
                       190                                       200                                       210
 730       740       750       760       770       780       790       800       810       820       830       840
TGAAGAATACACCCCCACTCGGTCACACTGATCAGTTCTGTCATTAATAAATCAAAGCCGCAAAGCCAGACGTCGTATTTAACACTCTGAACGGGATAGTAGCCTTTTTCAA
ACTTCTTATGTGGGGTGAGCCAGTGTGACTAGTCAAGACAGTAATTATTTTAGTTTCGGCGTTTCGGCTCTGCAGCATAAATTGTGAGACTTGCCCATCATTACATCCGGAAAAAGTT
Q  L  K  D  A  G  I  D  A  N  T  L  P  V  M  S  V  S  I  A  E  E  I  K  G  I  G  P  E  Y  L  K  G  H  L  V  T  W  N
                       230                                       240                                       250
 850       860       870       880       890       900       910       920       930       940       950       960
GCAATTAAAGGATGCCGGAGTTGACGCAAATACACTCCCTGTCATGAGCCGTGAGCATCGCCGAGGAGGAATCAAAGGCATTGGTCCAGATTGGTATTTAAAAGTCATCTGGTCACATGGAA
CGTTAATTTCCTACGCCCTCAACTGCGTTTATGTGAGGACAGTACTCCGCACTCGTCTCATAAAGTTCCGTAACCAGGTCTCAATAAATTTCCAGTAGACCAGTGTACCTT
```

```
       Y  F  Q  S  V  D  T  P  E  N  K  E  F  V  E  K  Y  K  K  Y  G  E  D  R  V  T  D  D  P  I  E  A  A  Y  I  G  V  Y  L
                              270                            280                            290
     CTATTTCCAAAGTGTAGATACACCGGAAAACAAGGAGTTCGTTGAGAAATATAAGAAAAAGTATGGGGAGGAGGACCGGGGTGACAGATGACCCAATCGAGGCGCATACATCGGCGTATACTT
     GATAAAGGTTTCACATCTATGTGGCCTTTTGTTCCTCAAGCAACTCTTTATATTCTTTTTCATACCCCTGCCCACTGTCTACTGGGTTAGCTCCGCCGTATGTAGCCGCATATGAA
           970          980          990         1000         1010         1020         1030         1040         1050         1060         1070         1080

W  A  K  A  V  E  K  A  G  S  T  D  V  D  K  V  R  E  A  A  K  G  I  E  F  N  A  P  E  G  P  V  K  I  D  G  D  N  Q  H
                              310                            320                            330
     ATGGGCTAAAGCGGTTGAGAAGGCGGGTCGACAGACGTGGATAAGGTCCGGGAGGAGGCATCGAAGGCCGCGAAGGGCATCGAATTTAACGCCCAGAGGGCCCAGTAAAGATTGACGGGACAACCAGCA
     TACCCGATTTCGCCAACTCTTCCGCCGCACTGTCTGCACCTATTCCAGGCCCTCCGGCGCTTCCCGGGTCTCCGGGTCTCATTTCTAACTGCCGCTGTTGGTCGT
          1090         1100         1110         1120         1130         1140         1150         1160         1170         1180         1190         1200

L  Y  K  T  V  R  I  G  E  I  L  E  N  G  Q  I  R  E  L  W  K  T  N  K  P  V  K  P  D  P  Y  L  K  G  Y  E  W  A  Q  G
                              350                            360                            370
     CCTCTACAGAGACGGTCGTATTGGTAGGAGATCCTGAGTTGGTGAGAACGGTCAAATTCGTAGTTGTGAAAACAAATAAACCAGTAAACCATATTTAAAAGGTTATGAATGGGCACAGG
     GGAGATGTTCTGCCACGCATAACACTCTAGGACCTCTTGCCAGTTTAAGCACTGAAACACCTTTTGTTATTTGGTCAATTTGGTCTAGGTATAAAATTTCCAATACTACCCGTCCC
          1210         1220         1230         1240         1250         1260         1270         1280         1290         1300         1310         1320

L  S  E  Q  G  G  S  H  H  H  H  H  H  *  *
                              390
     GTTAAGCGACAAGGTGGTTCACATCATCATCATCATCATTAATGAAAGGCGATATCCAGCACTGGCGCCGTTACTAGTGGATCCGGCTGCTAACAAAGCCCGAAAGGAAGCTGAG
     CAATTCGCTGCTTCCGTTCCACCAAGTGTAGTAGTAGTAGTAGTAATTACTTTCCGCTATAGGTCGTGACCGCGGCAATGATGATCAGGCCGACGATTGTTCGGCCTTCCTTCGACTC
          1330         1340         1350         1360         1370         1380         1390         1400         1410         1420         1430         1440

TTGGCTGCTGCTGCCACCGCTGACCGGCAATAACTAGCATAACCCCTTGGGCCTCTAAACGGGTCTTTTTGCTGAAAGGAGGAACTATATCCGGAGCGGACTCCCACGGCACGTTGG
     AACCGACGACGACGGTGGCGACTCGTTATTGATCGTATTGGGAACCCCGGAGAGATTTGCCAGAACTCCCCAAAAACGACTTTCCTCCTTGATATAGGCCTGCCTGAGGGTGCCGTGCAACC
          1450         1460         1470         1480         1490         1500         1510         1520         1530         1540         1550         1560

CAAGCTCGGAATTCGGCGTAATC
     GTTCGAGCCTTAAGCCGCATTAG
          1570         1580

FIG. 36 (Continued)
```

FIG. 37 - Exemplary Expression Construct for csUBP7_95C

```
GCCAGTAAGCTTCGGTACGCTTGGGACTGCCATAGGCTCCATAGGCTCCCGGTGATGCCGCCACGATGGCTCCGGCGTAGAGGATCGAGATCTCGATCCCGCGAAATTAATACGACTCACTATAG
         10         20         30         40         50         60         70         80         90        100        110        120
CGGTCATTCGAAGCCAGTGCAGCCCTGACGGTATCCGACGGTGCTACGCAGGCCGCATCCTCCTAGCTCTAGAGCTAGGGCGCTTTAATTATGCTGAGTGATATC
GGAGACCACAACGGTTCTCCCTCTAGAAATAATTTTGTTTAACTTTAAGAAGGAGATATACCATGAGTTCATCAGAATCAGAAAAAGAAGAGATGAAGAGCCATCAAAGTAGGGATTCT
        130        140        150        160        170        180        190        200        210        220        230        240
                                                             M  S  S  S  E  K  K  S  E  E  T  I  K  V  G  I  L
                                                                                   10
CCTCTGGTCGTTGCCAAAGGAGATCTTATTAAGAACAAATCTTAAAACAAATTGAAATTCTTCCTCATAGAGTCTTAGTCTTTTCTTTTTCACTTCTCTGGTAGTTCATCCCTAAGA
        130        140        150        160        170        180        190        200        210        220        230        240
 H  S  L  S  G  T  M  S  I  S  E  V  S  L  K  D  A  E  L  M  A  I  E  E  I  N  N  N  G  G  V  L  G  K  K  L  E  P  I  V
CCACAGCTTGAGTGGTACGATGTCAATCTCAGAAGTTCCTTAAAAGATGCGGAATTCAATAATGGCGGTGTGTTAGGTAAAAAGTTAGAACCGATCGT
        250        260        270        280        290        300        310        320        330        340        350        360
GGTGTCGAACTCACCATGTCTACAGTTGAGTCTTCAAAGGAATTTCTACGGCTTAATTACCGTTGTTATTACCGCCACACAATCATTTTCAATCTTGGCTAGCA
 E  D  G  A  S  D  W  P  T  F  A  E  K  K  A  K  K  L  L  Q  K  D  K  V  A  V  I  F  G  A  W  T  S  A  S  C  K  A  V  L  P
                                       70                                        80                                        90
GAAGATGGCGCCCTCAGACTGGCCGACCTTCGCTCAGAAGCTAGGCCGACCTGGCAGTGGCAGTAATTTTACAGAAGGACTAAGAAACTTTACAGAAGGACTAAGAAACTTTTCGGCGCTTGACCTGCGGTAAGCCCGTACTCCC
        370        380        390        400        410        420        430        440        450        460        470        480
CCTTCTACCGCGGAGTCTGACCGGCTGAGAAGCGACTTTTCCGATTCTTTGAAAATGTCTTCCTGTTCCACCGTCATTAAAAGCCGGAACCTGAGACCTTGAACATTTCGGCATGAGGG
 V  V  E  E  N  N  G  L  L  F  Y  P  V  Q  Y  E  G  L  E  S  S  P  N  I  F  Y  M  G  A  A  P  N  Q  Q  I  V  P  A  V  K
                                      110                                       120                                       130
AGTCGTCGAAGAAAATAATGGGCTTCTCTTCTATCCGGTTCAGTATGGAAGGTCTCGAGAGAGTTCCCCAAAATATCTTTACATGGGCGCCGCCCAAAACCAGCAGATCGTCCAGCAGTTAA
        490        500        510        520        530        540        550        560        570        580        590        600
TCAGCAGCTTCTTCTTTATTACCCGAAGAGAAGATAGGCCAAGTCATACTTCCAAGGGGTTTCATAAGAATTCCGTATGGAGTTTATGGAGCCGCCACAACATCATCC
 W  L  F  D  N  G  K  K  R  F  Y  L  L  G  S  D  Y  V  F  P  R  T  A  N  K  I  I  K  A  Y  L  K  Y  L  G  G  V  V  V  G
                                      150                                       160                                       170
ATGGCTCTTCGACAACGTGTAAGAACGGTTCTACCTCTTGGGCTCGGATTATGTATTCCCACGCCACAGCAAACAAGATTATTAAGGCATACTCAAATACCTCGGCGGTGTTGTAGTAGG
        610        620        630        640        650        660        670        680        690        700        710        720
TACCGAGAAGCTGTTGCCATTCTTCGCAAGATGGAGAACCCGAGCCTAATACATAAGGGTGCGTGTCGTTTGTTCTAATAATTCCTAATAATTCCGTATGGAGTTTATGGAGCCGCCACAACATCATCC
 E  E  Y  T  P  L  G  H  T  D  Y  S  S  V  I  N  K  I  K  A  A  K  P  D  V  V  F  N  T  L  N  G  D  S  N  V  A  F  F  K
                                      190                                       200                                       210
TGAAGAATACACCCCACTCGGTCACACTAGTTCTGTCATTAATAAAATCAAAGCCGATCGCGTATTTAACACTCTGAACGGGATAGTAGCCTTTTCAA
        730        740        750        760        770        780        790        800        810        820        830        840
ACTTCTTATGTGGGGTGAGCCAGTGTGACTGATATCAAGACAGTAATTATTTTAGTTTCGGCGTTTCGGCGCATAAATTGTGAGACTTGCCCCATCCATTACATCCGGAAAAAGTT
 Q  L  K  D  A  G  I  D  A  N  T  L  P  V  M  S  V  S  I  A  E  E  I  K  G  I  G  P  E  Y  L  K  G  H  L  V  T  W  N
                                      230                                       240                                       250
GCAATTAAAGGATGCCGGGATTGACGCAAATACACTCCCTGTCATGAGCCGTGAGCATCGCCGAGGAGAATCGCCGAGGAGAATCGCCGAGGAGAATCGCCGAGGAGAATCAAAGGCATTGGTCCAGATTGGTCCAGATTGGTAAAGTCATCTGGTCACATGAA
        850        860        870        880        890        900        910        920        930        940        950        960
CGTTAATTTCCTACGCCCCTACGCGTTATGTGAGGACAGTACTCCGCACTCGTAGCGGCTCCTCCTCTCAGTTCCGTACCAGTCTCATAAATTTCCAGTAGACCAGTTAAAATTTCCAGTGACCTT
```

```
            Y  F  Q  S  V  D  T  P  E  N  K  E  F  V  E  K  Y  K  K  Y  G  E  D  R  V  T  D  D  P  I  E  A  A  Y  I  G  V  Y  L
         CTATTTCCAAAGTGTAGATACACCGGAAAACAAGGAGTTCGTTGTTGAGAAATATAAGAAAAAGTATGGGAGGAGACCGGGGTGACAGATGACCCAATCGAGGCGGCATACATCGGCGTATACTT
         GATAAAGGTTTCACATCTATGTGGCCTTTTGTTCCTCAAGCAACTCTTTATATTCATACCCCCTCTGCCCACTGTCTACTGGGGTTAGCTCCGCCGTATGTAGCCGCATATGAA
            970       980       990      1000      1010      1020      1030      1040      1050      1060      1070      1080
                            310                                           330
            W  A  K  A  V  E  K  A  G  S  T  D  V  D  K  V  R  E  A  A  K  G  I  E  F  N  A  P  E  G  P  V  K  I  D  G  D  N  Q  H
         ATGGGCTAAAGCGGTTGAGAAGGCGGGTCGACAGAGACGTGGATAAGTCCGGAGAGGCCGGGAAGGGCATCGAATTTAACGCCCAGAGGGCCCAGTAAAGATTGACGGCGACAACCAGCA
         TACCCGATTTCGCCAACTCTTCCGCCCCAGCTGTCTGCACCTATTCCAGCGCTGTTCAGGTCCCAGCCTTCCCGGGTCTCATTTCTAACTGCCGCTGTTGGTCGT
           1090      1100      1110      1120      1130      1140      1150      1160      1170      1180      1190      1200
                            350                                           370
            L  Y  K  T  V  R  I  G  E  I  L  E  N  G  Q  I  R  E  L  W  K  T  N  K  P  V  K  P  D  P  Y  L  K  G  Y  E  W  A  Q  G
         CCTCTACAGAGACGGTGCGTATTGGTGAGATCCTGGAGAACGGTCAGTTGTGGAAAACAAATAAACCAGTAAACCAGATCCATATTTAAAAGGTTATGAATGGGCACAGG
         GGAGATGTCTGCCACGCCATAACCACTCTAGGACCCTTGCCAGTTTAAGACACTCAACACCTTTTGTTATTTGGTCAATTTCCAATACTACCCGTGTCCC
           1210      1220      1230      1240      1250      1260      1270      1280      1290      1300      1310      1320
                            390
            L  S  E  Q  G  G  S  H  H  H  H  H  H  *  *
         GTTAAGCGCAAGGTGGTTCACATCATCATCATCATCATTAATGAAAGGCCGATATCCAGCACTGGCGCCGTTACTAGTGGATCCGGCTGCTAACAAAGCCCGAAAGGAAGCTGAG
         CAATTCGCTGCTCGTTCCACCAAGTGTAGTAGTAGTAGTAGTAATTACTTTCCGGCTATAGGTCGTGACCGCCGGCAATGATCCACTAGGCCGACGATTGTTCGGGCTTCCTTCGACTC
           1330      1340      1350      1360      1370      1380      1390      1400      1410      1420      1430      1440
         TTGGCTGCTGCCACCGCTGCAATAACTAGCATAACCCCTTGGGCCTCTAAACGGGTCTTGAGGGGTTTTTTGCTGAAAGGAGAACTATATCCGGATAGGCCTGCGCTGAGGGTGCCGTGCAACC
         AACCGACGACGGTGGCGACTCGTTATTGATCGTATTGGATCGGGGAACCCCGGAGATTTGCCCAGAACTCCCAGAAACGACTTTCCTCCTTGATATAGGCCTGCCGCTGAGGGTGCCGTGCAACC
           1450      1460      1470      1480      1490      1500      1510      1520      1530      1540      1550      1560

CAAGCTCGGAATTCGGCGTAATC
         GTTCGAGCCTTAAGCCGCATTAG
           1570      1580

FIG. 37 (Continued)
```

FIG. 38 - Exemplary Expression Construct for csUBP7_111C

```
GCCAGTAAGCTTCGGTACGCTTGGGACTGCCATAGCTGGACCCGGTGATGCCGCCACGATGCTGCCGGCGTAGAGGATCGAGATCTCGATCCCGCGAAATTAATACGACTCACTATAG
CGGTCATTCGAAGCCAGTGCGAACCCTGACGGTATCCGACCTGGCCACTACGACGGCCGCATCCTCTAGAGCTAGGGCGCTTTAATTATGCTGAGTGATATC
         10         20         30         40         50         60         70         80         90        100        110        120
                                                                                                           M  S  S  S  E  K  K  S  E  E  T  I  K  V  G  I  L
GGAGACCACAACGGTTCCCTCTAGAAATAATTTGTTAACTTTAAGAAGGAGATATACCATGAGTTCATCAGAATCAGAAAAGAAAAAGTGAAGAGACCATCAAAGTAGGGATTCT
CCTCTGGTGTTGCCAAGGAGATCTTATTAAACAATTGAAATCTTCCTCATACTCAAGTAGTCTTAGTCTTTTCTTTTTTCACTTCTCTGGTAGTTCATCCCTAAGA
        130        140        150        160        170        180        190        200        210        220        230        240
                                                                                                    10
 H  S  L  S  G  T  M  S  I  S  E  V  S  L  K  D  A  E  L  M  A  I  E  E  I  N  N  N  G  G  V  L  G  K  K  L  E  P  I  V
CCACAGCTTGAGTGGTACCATGTCAATCTCAGAAGTTCCTTAAAAGATGCCGAATTAATGGCGATCGAAGATCAACAATAATGGCGGTGTTAGGTAAAAAGTTAGAACCGATCGT
GGTGTCGAACTCACCATGGTACAGTTAGATCTTCAAGGAATTTCTACGGCTTAATTACTAGTGTTATTACCGCCACAATCCATTTTTCAATCTTGGCTAGCA
        250        260        270        280        290        300        310        320        330        340        350        360
         30                                        40                                        50
 E  D  G  A  S  D  W  P  T  F  A  E  K  K  A  K  K  L  L  Q  K  D  K  V  A  V  I  F  G  A  W  T  S  A  S  R  K  A  V  L  P
GAAGATGGCGCCCTCAGACTGGCCGACCTTCGCTGAAAAGCTAAGAAACTTTACAGAAGGACTAAGAAACTTTCCGATTCTTGAAAATGTCTTCCTTGTCCACCGCTCATTAAAAGCCGCAAGCTCGGACCCTCGGAGCCGTTTCAGCGTTTCGGCATGAGGG
        370        380        390        400        410        420        430        440        450        460        470        480
         70                                        80                                        90
 V  V  E  E  N  N  G  L  L  F  C  P  V  Q  Y  E  G  L  E  S  S  P  N  I  F  Y  M  G  A  A  P  N  Q  Q  I  V  P  A  V  K
AGTCGTCGAAGAAAATAATGGGCTTCTCTTCTGTCCGGTTCAGTATGAAGGTCTCGAGACCTTCCGAAAGTTCCCCAAAATATCTTTACATGGCGCCGCCCCAAACCAGCAGATCGTGCCAGCAGTAA
TCAGCAGCTTCTTTATTACCCGAAGAGACAGGCCAAGTCATACTTCAAGGGGTTTATGAAAATGTACCCGGGGTTTGGTCGTCTAGCACGGTCGTCATT
        490        500        510        520        530        540        550        560        570        580        590        600
        110                                       120                                       130
 W  L  F  D  N  G  K  K  K  R  F  Y  L  L  G  S  D  Y  V  F  P  R  T  A  N  K  I  I  K  A  Y  L  K  Y  L  G  G  V  V  V  G
ATGGCTCTTCGACAACGGTAAGAAGCGTTTCTACCTTCTTGGGCTCGGATTATGTATTCCACGCACAGCACAAACAAGATTATTAAGGCATACTCAAATACCTCGGCGGTGTTGTAGTAGG
TACCGAGAAGCTGTTGCCATTCTTCGCAAGATGAGAACCCGAGCCTAATACATAAGGGTGCGTGTCGTTTGTCTCAATAATTCCGTATGAGTTTATGGAGCCGCCACAACATCATCC
        610        620        630        640        650        660        670        680        690        700        710        720
        150                                       160                                       170
 E  E  Y  T  P  L  G  H  T  D  Y  S  S  V  I  N  K  I  K  A  A  K  P  D  V  V  F  N  T  L  N  G  D  S  N  V  A  F  F  K
TGAAGAATACACCCCACTCGGTCACACTGACTATAGTTCTGTCATTAATAAATCAAAGCCGCAGAGCGTCGTATTTAACACTCTGAACGGGGATAGTAGCCTTTTCAA
ACTTCTTATGTGGGGTGAGCCAGTGTGACTGATATCAAGACAGTAATTATTTAGTTTCGGCGTTCGCAGCATAAATTGTGAGACTTGCCCATCATTACATCGGAAAAGTT
        730        740        750        760        770        780        790        800        810        820        830        840
        190                                       200                                       210
 Q  L  K  D  A  G  I  D  A  N  T  L  P  V  M  S  V  S  I  A  E  E  I  K  G  I  G  P  E  Y  L  K  G  H  L  V  T  W  N
GCAATTAAAGGATGCCGGGATTGACGCAAATACACTCCCTGTCATGAGCGTGAGCATCGCCGAGGAGGAGATCAAAGGCATTGGTCCAGATGTATTAAAAGGTCATCTGGTCACATGAA
CGTTAATTTCCTACGGCCCTAACTGCGTTATGTGAGGACAGTACTCCGCACTCGTAGCGGCGTCCTCCTCTAGTTTCCGTACCAGTCTCATAAATTTCCAGTAGACCAGTGTACCTT
        850        860        870        880        890        900        910        920        930        940        950        960
        230                                       240                                       250
```

```
       270                    280                     290
Y  F  Q  S  V  D  T  P  E  N  K  E  F  V  E  K  Y  K  K  Y  G  E  D  R  V  T  D  D  P  I  E  A  A  Y  I  G  V  Y  L
CTATTTCCAAAGTGTAGATACACCGGAAAACAAGGAGTTCGTTGAGAAATATAAGAAAAAGTATGGGGAGGACCGGGTGACAGATGACCAATCGAGGCGGCATACATCGGCGTATACTT
GATAAAGGTTTCACATCTATGTGGCCTTTTGTTCCTCAAGCAACTCTTTATATTCTTTTTCATACCCCCTGCCCACTGTCTACTGGGTTAGCTCCGCCGTATGTAGCCGCATATGAA
 970        980        990        1000       1010       1020       1030       1040       1050       1060       1070       1080

310                    320                    330
W  A  K  A  V  E  K  A  G  S  T  D  V  D  K  V  R  E  A  A  K  G  I  E  F  N  A  P  E  G  P  V  K  I  D  G  D  N  Q  H
ATGGGCTAAAGCGGTTGAGAAGCGGGTCGACAGACGTCGATAAGTCCGGGAGGCATCGAATTTAACGCCCAGAGGGCCCAGTAAAGATTGACGGCGACAACCAGCA
TACCCGATTTCGCCAACTCTTCGCCCAGCTGTCTGCACCTATTCCAGGCCCTCCGTAGCTTAAATTGCGGGTCTCATTTCTAACTGCGCTGTTGGTCGT
 1090       1100       1110       1120       1130       1140       1150       1160       1170       1180       1190       1200

350                    360                    370
L  Y  K  T  V  R  I  G  E  I  L  E  N  G  Q  I  R  E  L  W  K  T  N  K  P  V  K  P  D  P  Y  L  K  G  Y  E  W  A  Q  G
CCTCTACAGAGCGGTCGTATTGGTGAGATCCTGGAGAACGGTCAGTTCGTGAAATTCGTAAACAAATAAACCAGTAAACCATATTTAAAAGTTATGAATGGGCACAGG
GGAGAGTGTTCTGCCACGCATAACACTCTAGGACCACTTGCCAGTTAAGCACTCAACACCTTTTGTTTATTTGGTCAATTTGTCTAGTATAAATTTCCAATACTACCCGTCCC
 1210       1220       1230       1240       1250       1260       1270       1280       1290       1300       1310       1320

390
L  S  E  Q  G  G  S  H  H  H  H  H  H  *  *
GTTAAGCAGCAAGGTGTTCACATCATCATCATCATCATTAATGAAAGGCGATATCCAGCACTGGCGCCGTCGTAACAAGCCCGAAAGGAAGCTGAG
CAATTCGTCGTTCCACCAAGTGTAGTAGTAGTAGTAGTAGTTAATTACTTTCGCTATATATTAGGCGCAATGATCGTGACCGACGATTGTTCGGCTTCCTTCGACTC
 1330       1340       1350       1360       1370       1380       1390       1400       1410       1420       1430       1440

TTGGCTGCTGCTGCCACCGCTGAGCAATAACTAGCATAACCCCCTTTGGGGCCTCTAAACGGGTTCTTTTTGCTGAAAGGAGGAACTATATCCGAGCGGACTCCCACGGGCACGTTGG
AACCGACGACGACGGTGGGCACTCGTTATTGATCGATCGTATTCGTATGGGAACCCCGGAGAGATTTGCCAGAACTCTCCTTGATATAGGCCTGCCTGCTGAGGGTGCCGTGCAACC
 1450       1460       1470       1480       1490       1500       1510       1520       1530       1540       1550       1560

CAAGCTCGGAATTCGGCGTAATC
GTTCGAGCCTTAAGCCGCATTAG
 1570       1580

FIG. 38 (Continued)
```

FIG. 39 - Exemplary Expression Construct for csUBP7_114C

```
            270                             280                             290
Y  F  Q  S  V  D  T  P  E  N  K  E  F  V  E  K  Y  K  K  Y  G  E  D  R  V  T  D  D  P  I  E  A  A  Y  I  G  V  Y  L
CTATTTCCAAAGTGTAGATACACCGGAAAACAAGAGTTCGTTGAGAAATATAAGAAAAAGTATGGGAGGAGACCGGTGACAGATGACCAATCGAGGCGGCATACATCGGCGTATACTT
GATAAAGGTTTCACATCTATGTGGCCTTTTGTTCCTCAAGCAACTCTTATATTCTTTTTCATACCCCTCCTGCCCACTGTCTACTGGGTTAGCTCCGCCGTATGTAGCCGCATATGAA
     970       980       990      1000      1010      1020      1030      1040      1050      1060      1070      1080

310                             320                             330
W  A  K  A  V  E  K  A  G  S  T  D  V  D  K  V  R  E  A  A  K  G  I  E  F  N  A  P  E  G  P  V  K  I  D  G  D  N  Q  H
ATGGGCTAAAGCGGTTGAGAAGGCGGGTCGACAGACGTGGATAAGGTCCGGGAGGAGGCCATGCATCGAATTTAACGCCCAGAGGGCCCAGTAAAGATTGACGGCGACAACCAGCA
TACCCGATTTCGCCAACTCTTCGCCCCAGCTGTCTGCACCTATTCCAGGCCCTCCGGTACGTAGCTTAACATTGCGGGTCTCCGGGTCATTTCTAACTGCCTGTTGGTCGT
    1090      1100      1110      1120      1130      1140      1150      1160      1170      1180      1190      1200

350                             360                             370
L  Y  K  T  V  R  I  G  E  I  L  E  N  G  Q  I  R  E  L  W  K  T  N  K  P  V  K  P  D  P  Y  L  K  G  Y  E  W  A  Q  G
CCTCTACAAGACGGTCGTATTGGTGAGATCCTGGAGAACGGTCAAATTCGTGAGTTGTGAAAACAAATAAACCAGTAAACCAGATCCATATTTAAAAGGTTATGAATGGGCACAGG
GGAGATGTTCGCCACGCATAACCACTCTAGGACCCTCTTGCCAGTTAAGCACTCAACACCTTTGTTATTTGGTCAATTGGTCCTAGAGCTAAATTCCAATACTAAATTTCCAATACTACCCGTGTCCC
    1210      1220      1230      1240      1250      1260      1270      1280      1290      1300      1310      1320

390
L  S  E  Q  G  G  S  H  H  H  H  H  H  *  *
GTTAAGCAGCAAGGTGGTTCACATCATCATCATCATCATTAATGAAAGGCCGATATCCAGCACTGGCGCCGTTACTAGTCGGATCCGGCTGCTAACAAAGCCCGAAAGGAAGCTGAG
CAATTCGCTCGTTCCACCAAGTGTAGTAGTAGTAGTAGTAATTACTTTCCGGCTATAGGTCGTGACCGCCAATGATGATCAGCCTAGCCGACGATTGTTCGGCTTCCTTCCTGACTC
    1330      1340      1350      1360      1370      1380      1390      1400      1410      1420      1430      1440

TTGGCTGCTGCCACCGCTGACCGGCAATAACTAGCATAACCCCTTGGGCCTCTAAACGGGTCTTGAGGGTTTTTTGTGAAAGGAGGAACTATATCCGAGCGGACTCCCACGGCACGTTGG
AACCGACGACGGTGGCGACTCGTTATTGATCGTATTGGATCCCTTGGGAAACCCGAGATTGCCAGAACTCCTTCCTCCTTGATATAGGCCTGCTGAGGGTGCCGTGCAACC
    1450      1460      1470      1480      1490      1500      1510      1520      1530      1540      1550      1560

CAAGCTCGGAATTCGGCGTAATC
GTTCGAGCCTTAAGCCGCATTAG
    1570      1580

FIG. 39 (Continued)
```

FIG. 40 - Exemplary Expression Construct for csUBP7_115C

```
        270                     280                     290                     300
V  D  T  P  E  N  K  E  F  V  E  K  Y  K  K  K  Y  G  E  D  R  V  T  D  D  P  I  E  A  A  Y  I  G  V  V  Y  L  W  A  K  A
TGTAGATACACCGGAAAACAAGGAGTTCGTTGAGAAATATAAGAAAAAGTATGGGGAGGACCGGGTGACAGATGACCCAATCGAGGCGGCATACATCGGCGTATACTTATGGGCTAAAGC
ACATCTATGTGGCCTTTTGTTCCTCAAGCAACTCTTTATATTCTTTTCTAAGCAACACCCCTCTGGCCCACTGTCTACTGGGTTAGCTCCGCCGTATGTAGCCGCATATGAATACCGATTCG
    970       980       990       1000      1010      1020      1030      1040      1050      1060      1070      1080

310                     320                     330                     340
V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACAGACGTGGATAAGGTCCGGGAGGCCGCGAAAGGCATCGAATTTAACGCCCAGAGGGCCCAGTGTAAAGATTGACGGCGACAACCAGCACCTCTACAAGAC
CCAACTCTTCCGCCCCAGCTGTCTGCACCTATTCGAGGCCCTCCGGCGCTTTCCGGTCATTTCTAACTGCCGCTGTTGGTCGTGGAGATGTTCTG
    1090      1100      1110      1120      1130      1140      1150      1160      1170      1180      1190      1200

350                     360                     370                     380
V  R  I  G  E  I  L  E  N  G  Q  I  R  E  L  W  K  T  N  K  P  V  K  P  D  P  Y  L  K  G  Y  E  W  A  Q  G  L  S  E  Q
GGTGCGTATTGGTGAGATCCTGGAGAACGGTCAAATTCGTGAGTTGTGGAAAACAAATAAACCAGTTAAACCAGATCCATATTTAAAAGGTTATGAATGGCACAGGGGTTAAGCGAGCA
CCACGCATAACCACTCTAGGACCTCTTGCCAGTTTAAGCACTCAACACCCTTTGTTTATTGGTCTAGTATAAATTTTCCAATACTACCCGTGTCCCAATTCGCTCGT
    1210      1220      1230      1240      1250      1260      1270      1280      1290      1300      1310      1320

390
G  G  S  H  H  H  H  H  H  *  *  *
AGTGGTTCACATCATCATCATCATCATTAATGAAAGGGCGATATCCAGCACTGGCGGCCGTTACTAGTGGATCCTCTAACAAAGCCCGAAAGGAAGCTGAGTTGGCTGCTGCC
TCCACCAAGTGTAGTAGTAGTAGTAGTAATTACTTTCCGCTATAGGTCGTGTGACCGCAATGATCACCTAGGCCGACGATTGTTCGGCCTTCGGCCTTCGACTGTTCGACTGCTGAAAGCTGAAGCTGAACGGACGACGG
    1330      1340      1350      1360      1370      1380      1390      1400      1410      1420      1430      1440

ACCGGCTGAGCAATAACTAGCATAACCCCTTGGGGCCTCTAAACGGGTCTTGAGGGGTTTTTGCTGAAAGGAGGAACTATATCCGGAGGCGACTCCCACGGCACGTTGGCAAGCTCG
TGGCCGACTCGTTATTGATCGTATTGGGGAACCCCGGAGATTTGCCCAGAACTCCCAAAAACGACTTTCCTCCTTGATATAGGCCTCGCTGAGGGTGCCGTGCAACCGTTCGAGC
    1450      1460      1470      1480      1490      1500      1510      1520      1530      1540      1550
```

FIG. 40 (Continued)

FIG. 41 - Exemplary Expression Construct for csUBP7_116C

```
           270              280              290                300
V D T P E N K E F V E K Y K K K Y G E D R V T D D P I E A A Y I G V V Y L W A K A
TGTAGATACACCGGAAAACAAGGAGTTCGTTGAGAAATATAAGAAAAAGTATGGGAGGACCGGGTGACAGATGACCCAATCGAGGCGGCATACATCGGCGTATACTTATGGGCTAAAGC
ACATCTATGTGGCCTTTTGTCCTCAAGCAACTCTTTATATTCTTTTCATACCCCTCGGCCCACTGTCTACTGGGTTAGCTCCGCCTATGTAGCCGCATATGAATACCCGATTTCG
     970        980       990       1000      1010      1020      1030      1040      1050      1060      1070      1080
           310              320                330               340
V E K A G S T D V D K V R E A A K G I E F N A P E G P V K I D G D N Q H L Y K T
GGTTGAGAAGGCGGGGTCGACAGACGTGGATAAGGTCCGGGAGGCATCGAATTTAACGCCCAGAGGGCCCAGTGAAATTGACGGCGACAACCAGCACCTCTACAAGAC
CCAACTCTTCCGCCCCAGCTGTCTGCACCTATTCGAGGCCCTCCGTAGCTTAAATTGCGGGTCATTTCTAACTGCGCTGTTGGTCGTGGAGATGTTCTG
     1090      1100      1110      1120      1130      1140      1150      1160      1170      1180      1190      1200
           350              360                370               380
V R I G E I L E N G Q I R E L W K T N K P V K P D P Y L K G Y E W A Q G L S E Q
GGTGCGTATTCGTGAGATCCTGGAGAACGGTCAAATTCGTGAGTTGTGGAAAACAAATAACAGTTAAACCAGATCCATATTTAAAAGGTTATGAATGGCACAGGGGTTAAGCGAGCA
CCACGCATAACCACTCTAGGACCTCTTGCCAGTTTAAGCACTCAACCCTTTGTTTATTGGTCCAGTATAAATTTTCCAATACTTACCCGTGTCCCAATTCGCTCGT
     1210      1220      1230      1240      1250      1260      1270      1280      1290      1300      1310      1320
           390
G G S H H H H H H * * *
AGTGGTTCACATCATCATCATCATCATTAATGAAAGGGCGATATCCAGCACACTGGCGGCCGTTACTAGTGGATCCGGCTGCTAACAAAGCCCGAAAGGAAGCTGAGTTGGCTGCTGCC
TCCACCAAGTGTAGTAGTAGTAGTAGTAATTACTTTCCCGCTATAGGTCGTGTGACCGCCAATGATCACCTAGGCCGACGATTGTTCGGCCTTCCTTCGACTGTTCTTCGACTCAACCGACGACGGG
     1330      1340      1350      1360      1370      1380      1390      1400      1410      1420      1430      1440
ACCGCTGAGCAATAACTAGCATAACCCTTGGGCCTCTAAACGGGTCTTGAGGGTTTTTGCTGAAAGGAGGAACTATATCCGGAGCGACTCCCACGGCACGTTGGCAAGCTCG
TGGCCGACTCGTTATTGATCGTATTGGGGAACCCCGGAGATTTGCCCAGAACTCCCAGAAAAACGACTTCCTCCTTGATATAGGCCTCGCTGAGGGTGCCGTGCAACCGTTCGAGC
      1450      1460      1470      1480      1490      1500      1510      1520      1530      1540      1550

FIG. 41 (Continued)
```

FIG. 42 - Exemplary Expression Construct for csUBP7_157C

```
         V  D  T  P  E  N  K  E  F  V  E  K  Y  K  K  K  Y  G  E  D  R  V  T  D  D  P  I  E  A  A  Y  I  G  V  V  Y  L  W  A  K  A
              270                         280                         290                         300
       TGTAGATACACCCGGAAAACAAGGAGTTCGTTGAGAAATATAAGAAAAAAGTATGGGAGGACCGGGTGACAGATGACCCAATCGAGGCGGCATACATCGGCGTATACTTATGGGCTAAAGC
       ACATCTATGTGGCCTTTTGTTCCTCAAGCAACTCTTTATATTCTTTTCTTACATACCCCTCCTGGCCCACTGTCTACTGGGTTAGCTCCGCCGTATGTAGCCGCATATGAATACCCGATTCG
               980         990         1000        1010        1020        1030        1040        1050        1060        1070        1080
         V  E  K  A  G  S  T  D  V  D  K  V  R  E  A  A  K  G  I  E  F  N  A  P  E  G  P  V  K  I  D  G  D  N  Q  H  L  Y  K  T
              310                         320                         330                         340
       GGTTGAGAAGGCGGGGTCGACAGACGTGGATAAGGTCCGGGAGGCCGCGAAAGGCATCGAATTTAACGCCCAGAGGGCCCAGTAAAGATTGACGGCGACAACCAGCACCTCTACAAGAC
       CCAACTCTTCCGCCCCAGCTGTCTGCACCTATTCGAGGCCCTCCGGCGCTTCCGTAGCTTAAATTGCGGGTCTCCGGGTCATTCTAACTGCCGCTGTTGGTCGTGGAGATGTTCTG
               1090        1100        1110        1120        1130        1140        1150        1160        1170        1180        1190        1200
         V  R  I  G  E  I  L  E  N  G  Q  I  R  E  L  W  K  T  N  K  P  V  K  P  D  P  Y  L  K  G  Y  E  W  A  Q  G  L  S  E  Q
              350                         360                         370                         380
       GGTGCGTATTCGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCA
       CCACGCATAAGCACTCTAGGACCTCTTGCCAGTTTAAGCACTCAACACCTTTTGTTTATTGGTCTAGGTATAAATTTTCCAATACTACCCGTGTCCCCAATTCGCTCGT
               1210        1220        1230        1240        1250        1260        1270        1280        1290        1300        1310        1320
         G  G  S  H  H  H  H  H  H  *  *  *
              390
       AGTGGTTCACATCATCATCATCATCATTAATGAAAGGGCGATATCCAGCACACTGGCGCCCGTTACTAGTGGATCCGCTCTAACAAAGCCCGAAAGGAAGCTGAGTTGGCTGCTGCC
       TCCACCAAGTGTAGTAGTAGTAGTAGTAATTACTTTCCCGCTATAGGTCGTGTGACCGCCGCAATGATCACCTAGGCCGACGATTGTTCGCGGCTTTCCTTCGACTCAACCGACGACGG
               1330        1340        1350        1360        1370        1380        1390        1400        1410        1420        1430        1440

ACCGCTGAGCAATAACTAGCATAACCCCTTGGGGCCTCTAAACGGGTCTTGAGGGGTTTTTTGCTGAAAGGAGAACTATATCCGGAGCGACTCCCACGGCACGTTGGCAAGCTCG
       TGGCGACTCGTTATTGATCGTATTGGGGAACCCCGGAGATTTGCCCAGAACTCCCAAAAAACGACTTTCCTCCTTGATATAGGCCTCGCTGAGGGTGCCGTGCAACCGTTCGAGC
               1450        1460        1470        1480        1490        1500        1510        1520        1530        1540        1550

FIG. 42 (Continued)
```

FIG. 43 - Exemplary Expression Construct for csUBP7_158C

```
                                270                     280                      290                     300
      V  D  T  P  E  N  K  E  F  V  E  K  Y  K  K  Y  G  E  D  R  V  T  D  D  P  I  E  A  A  Y  I  G  V  V  Y  L  W  A  K  A
      TGTAGATACACCGGAAAAACAAGGAGTTCGTTGAGAAATATAAGAAAAAGTATGGGGAGGACCGGGTGACAGATGACCCAATCGAGGCGGCATACATCGGCGTATACTTATGGGCTAAAGC
      ACATCTATGTGGCCTTTTGTTCCTCAAGCAACTCTTTATATTCTTTTTCATACCCCTCCTGGCCCACTGTCTACTGGGTTAGCTCCGCCTATGTAGCCGCATATGAATACCCGATTTCG
        970          980         990         1000         1010        1020        1030         1040        1050        1060        1070        1080
                                310                     320                      330                     340
      V  E  K  A  G  S  T  D  V  D  K  V  R  E  A  A  K  G  I  E  F  N  A  P  E  G  P  V  K  I  D  G  D  N  Q  H  L  Y  K  T
      GGTTGAGAAGGCGGGGTCGACAGACGTGGATAAGGTCCGGGAGGCCGCGAAAGGCATCGAATTTAACGCCCAGAGGGCCCAGTAAAGATTGACGGCGACAACCAGCACCTCTACAAGAC
      CCAACTCTTCCGCCCCAGCTGTCTGCACCTATTCGAGGCCCTCCGGCGCTTTCCGTAGTCATTTCTAAGTTGCGGGACGTCCCGGGTCAGTTCTAACTGCGCTGTTGGTCGTGGAGATGTTCTG
        1090        1100        1110        1120         1130        1140        1150         1160        1170        1180        1190        1200
                                350                     360                      370                     380
      V  R  I  G  E  I  L  E  N  G  Q  I  R  E  L  W  K  T  N  K  P  V  K  P  D  P  Y  L  K  G  Y  E  W  A  Q  G  L  S  E  Q
      GGTGCGTATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCA
      CCACGCATAACCACTCTAGGACCTCTTGCCAGTTTAAGCACTCAACACCTTTGTTATTGGTCAATTTGGTCTAGTATATAAATTTTCCAATACTACCCGTGTCCCAATTCGCTCGT
        1210        1220        1230        1240         1250        1260        1270         1280        1290        1300        1310        1320
                                390
      G  G  S  H  H  H  H  H  H  *  *  *
      AGTGGTTCACATCATCATCATCATCATTAATGAAAGGGCGATATCCAGCACACTCGGCGCCGTTACTAGTGGATCCGGCTGCTAACAAAGCCCGAAAGGAAGCTGAGTTGGCTGCTGCC
      TCACCAAGTGTAGTAGTAGTAGTAGTAGTAATTACTTTCCGCTATAGGTCGTGTGACCGCCGCAATGATCACCTAGGCCGACGATTGTTTCGGCGTTCGACTCAACCGACGACGG
        1330        1340        1350        1360         1370        1380        1390         1400        1410        1420        1430        1440

ACCGGCTGAGCAATAACTAGCATAACCCCTTGGGGCCTCTAAACGGGTCTTGAGGGGTTTTTTGCTGAAAGGAGGAACTATATCCGGAGCGACTCCCACGGCACGTTGGCAAGCTCG
      TGGCCGACTCGTTATTGATCGTATTGGGGAACCCCGGAGATTTGCCCAGAACTCCCCAAAAACGACTTCCTCCTTGATATAGGCCTCGCTGAGGGTGCCGTGCAACCGTTCGAGC
        1450        1460        1470        1480         1490        1500        1510         1520        1530        1540        1550
```

FIG. 43 (Continued)

FIG. 44 - Exemplary Expression Construct for csUBP7_159C

```
       10         20         30         40         50         60         70         80         90        100        110        120
GCCAGTAAGCTTCGGTACGCTTGGGACTGCCATAGGCTGGCCCGGTGATGCCGGCCACGATGCGTCCGGCGTAGAGGATCGAGATCTCGATCCCGCGAAATTAATACGACTCACTATAG
CGGTCATTCGAAGCCAGTGCGAACCCTGACGGTATCCGACCGGGCCACTACGGCCGGTGCTACGCAGGCCGCATCCTAGAGCTAGGGCGCTTAATTATGCTGAGTGATATC
                                                                   M  S  S  S  E  K  E  K  S  E  E  T  I  K  V  G  I  L
                                                                                                    10
      130        140        150        160        170        180        190        200        210        220        230        240
GGAGACCACAACGGTTTCCCTCTAGAAATTTGTTAACTTTAAGAAGGAGATATACCATGAGTTCATCGAGTAATCAGAAGAAAAAGAGTGAAGAGACCATCAAAGTAGGGATTCT
CCTCTGGTGTTGCCAAAGGGAGATCTTATTAAACAATTGAAAATTCTTCCTATATGGTACTCAAGTAGTCATTAGTCTTTTCTTTTTCACTTCTCTGGTAGTTCATCCCTAAGA
 L  L
  H  S  L  S  G  T  M  S  I  S  E  V  S  L  K  D  A  E  L  M  A  I  E  E  I  N  N  N  G  V  L  G  K  K  L  E  P  I  V
              30                              40                              50
      250        260        270        280        290        300        310        320        330        340        350        360
CCACAGCTTGAGTGGTACGATGTCAATCTCAGAAGTTTCCTTAAAAGATGCCGAATTAATGGCGGTGTTAGGTAAAAAGTTAGAACCGATCGT
GGTGTCGAACTCACCATGCTACAGTTAGAGTCTTCAAAGGAATTTTCTACGGCTTAATTACCGCCACAATCATTTTCAATCTTGGCTAGCA
  E  D  G  A  S  D  W  P  T  F  A  E  K  K  L  L  Q  K  D  K  V  A  V  I  F  G  A  W  T  S  A  S  R  K  A  V  L  P
                      70                              80                              90
      370        380        390        400        410        420        430        440        450        460        470        480
GGAAGATGGCGCCCTCAGACTGGCCGACCTTCGCTGAAAAGCTAAGAAACTTTACAGAAGGACAAAGTCTTCCTGATTCTTTGAAAATGTCTTCCACCGTCATTAAAAGCCGGCGAACCTGAGCCGTTCAGCGTTTCGGCATGAGGG
CCTTCTACCGCCGGAGTCTGACCGGCTGACCGGGCTGGAAGCGACTTTGATTCTTTGAAAATGTCTTCCACCGTCATTAAAAGCCGGCGAACCTGAGCCGTTCAGCGTTTCGGCATGAGGG
         100                     110                             120                             130
      490        500        510        520        530        540        550        560        570        580        590        600
AGTCGTCGAAGAAAATAATGGGCTTCTCTTCTATCCGGTTCAGTATGGAAGGTCTCGAAAGTTCCCAAATATCTTTACATGGGCGCCGCCCCAAACCAGCAGATCGTGCCAGCAGTAA
TCAGCAGCTTCTTTATTACCCGAAGAGAAGATAGGCCAAGTCATACTTCAAGGGGTTTATGAAAATGTACCCGCGGCGGGTTTGGTCGTCTAGCACGGTCGTCAATT
                                          150                             160                             170
      610        620        630        640        650        660        670        680        690        700        710        720
ATGGCTCTTCGACAACGGTAAGAACGTTTCTACCTCTTCGGGCTCGGATTATGATGCCCACGCACAGCAAACAAGATTATTAAGGCATACCTCAAATACCTCGGCGGTGTTGTAGTAGG
TACCGAGAAGCTGTTGCCATTCTTCGCAAGATGAGGAAGCCTAATCACGGGTGCGTCGTTTGTTCTCAATAATTCCGTATGAGTTTATGGAGCCGCCACAACATCATCC
           180                             190                             200                             210
      730        740        750        760        770        780        790        800        810        820        830        840
TGAAGAATACACCCCCACTCGGTCACACTGGTCACTATAGTTCTGTCATTAATAAATCAAAGCCGCAAAGCCAGACGTCGTATTTAACACTCTGAACGGGATAGTAGCCTTTTCAA
ACTTCTTATGTGGGGTGAGCCAGTGTGACTGTGATATGACTTTTAGTTTCGGCGTTCGGCGTTCGGCGCATAAATTGTGAGACTTGCCATCATTACATCGGAAAAGTT
                   220                             230                             240
      850        860        870        880        890        900        910        920        930        940        950        960
GCAATTAAAGGATGCCGGATTGACGCAAATACACTCCCTGTCATGACGTGAGCATCGCCGAGGAGAATCGCCGAGTTGGTCCAGATTGTATTTAAAAGTCATCTGGTCACATGAA
CGTTAATTTCCTACGGCCCTAACTGCGTTTATGTGAGGACAGTACTCCGCACTGTAGCGGCCTCCTCCTAAGCGGCTCAATAAATTTCCAGTAGACCAGTGTACCTT
```

```
        Y   F   Q   S   V   D   T   P   E   N   K   E   F   V   E   K   Y   K   K   K   Y   G   E   D   R   V   T   D   D   P   I   E   A   A   Y   I   G   V   Y   L
CTATTTCCAAAGTGTAGATACACCGGAAAACAAGGAGTTCGTTGAGAAATATAAGAAAAGTATGGGAGGACCGGGTGACAGATGACCCAATCGAGGCCGCATACATCGGCGTATACTT
GATAAAGGTTTCACATCTATGTGGCCTTTTGTTCCTCAAGCAACTCTTTATATTCTTTTTCATACCCTGTCTACTGGGTTAGCTCCGCCGTATGTAGCCGCATATGAA
    970         980         990        1000        1010        1020        1030        1040        1050        1060        1070        1080

W   A   K   A   V   E   K   A   G   S   T   D   V   D   K   V   R   E   A   A   K   G   I   E   F   N   A   P   E   G   P   V   K   I   D   G   D   N   Q   H
ATGGGCTAAAGCGGTTGAGAAGGCGGGGTCGACAGACGTGGATAAGGTTCGAGAGGCCGCGAAGGGCATCGAATTCAATGCCCCAGAGGGCCCAGTAAAGATTGACGGCGACAACCAGCA
TACCCGATTTCGCCAACTCTTCCGCCCCAGCTGTCTGCACCTATTCCAGGCGCTTCCCGTAGCTTAAAATTACGGGGTCTCCCGGGGTCATTCTAACTGCCGCTGTTGGTCGT
   1090        1100        1110        1120        1130        1140        1150        1160        1170        1180        1190        1200

L   Y   K   T   V   R   I   G   E   I   L   E   N   G   Q   I   R   E   L   W   K   T   N   K   P   V   K   P   D   P   Y   L   K   G   Y   E   W   A   Q   G
CCTCTACAAGACGGTTGCGTATTGGTGCTGGAGAACGGTCAAATTCGTGAGTTGTGGAAAACAAATAACCAGTTAAACATCCATATTTAAAAGGTTATGAATGGGCACAGGG
GGAGATGTTCTGCCACGCAATAACCACTCTAGGACCTCTTGCCAGTTTAAGCTTTAAGCTTTGTTATTTGTTCAATTTGGTCTAGGTATAAATTTTCAATACTACCCGTGTCCC
   1210        1220        1230        1240        1250        1260        1270        1280        1290        1300        1310        1320

L   S   E   Q   G   G   S   H   H   H   H   H   H   *   *
GTTAAGCGACCAAGGTGGTTCACATCATCATCATCATCATTAATGAAAGGGCGATATCCAGCACACTGGCGCCGTCTAACAAAGCCCGTCTAACAAAGAGAAGGAAGCTGAG
CAATTCGCTCGTCTTCCACCAAGTGCGTATTGTAGTAGTAGTAATTACTTCCCGCTATAGGTCGTGTGACCGCCGCAATGATCACCTAGGCCGACGATTGTTTCGGCTTTCCTTCGACTC
   1330        1340        1350        1360        1370        1380        1390        1400        1410        1420        1430        1440

TTTGGCTGCTGCCACCGTGAGCAATAACTAGCATAACCCCTTGGGCCTCTAAACGGGTCTTGAGGGGTTTTTTGCTGAAAGGAGGAACTATATCCGAGCGACTCCCACGGCACGTTGG
AACCGACGACGGTTGGGCGACTCGTTATTGATCGTATTTGGGAACCCCGAGATTTGCCCAGAACTTGCCTGCTGAGGGTGCCGTCAACC
   1450        1460        1470        1480        1490        1500        1510        1520        1530        1540        1550        1560

CAAGCTCGGAATTCGGCGTAATC
GTTCGAGCCCTTAAGCCGCATTAG
   1570        1580

FIG. 44 (Continued)
```

FIG. 45 - Exemplary Expression Construct for csUBP7_186C

```
           Y  F  Q  S  V  D  T  P  E  N  K  E  F  V  E  K  Y  K  K  K  Y  G  E  D  R  V  T  D  D  P  I  E  A  A  Y  I  G  V  Y  L
           CTATTTCCAAAGTGTAGATACACCGGAAAACAAGGAGTTCGTTGAGAAATATAAGAAAAAAGTATGGGAGGAGATGACAGATGACCCAATCGAGGCGCATACATCGGCGTATACTT
           GATAAAGGTTTCACATCTATGTGGCCTTTTGTTCCTCAAGCAACTCTTTATATTCTTTTTCATACCCCTCTGCCCACTGGGTTAGCTCCGCCGTATGTAGCCGCATATGAA
                  970        980        990       1000       1010       1020       1030       1040       1050       1060       1070       1080

320
              W  A  K  A  V  E  K  A  G  S  T  D  V  D  K  V  R  E  A  A  K  G  I  E  F  N  A  P  E  G  P  V  K  I  D  G  D  N  Q  H
              ATGGGCTAAAGCGGTTGAGAAGCGGGTCGACAGACGTTGGATAAGTCCGGAGGAGGCCATCGATGTCGATAAAGGCCCAGTAAAGATTAACGCGGACGGACAACCAGCA
              TACCCGATTTCGCCAACTCTTCGCCCACTCTGTCTGCCAGCTGTCTGCACCTATTCCAGGCCTCTCCGGTAGCTACAAATTGCGGGTCTCATTTCTAACTGCCTGTTGGTCGT
                     1090       1100       1110       1120       1130       1140       1150       1160       1170       1180       1190       1200

360                                                   370
               L  Y  K  T  V  R  I  G  E  I  L  E  N  G  Q  I  R  E  L  W  K  T  N  K  P  V  K  P  D  P  Y  L  K  G  Y  E  W  A  Q  G
               CCTCTACAGACGGGTCGTATTGGTGGAGATCCTGGAGAACGGTCAGATTCGTGAGTTGTGGAAAACAAATAAACCAGTAAACCAGATCCATATTTAAAAGGTTATGAATGGGCACAGG
               GGAGATGTCTGCCACGCATAACCACTCTAGGACCTTGCCAGTTAAGATTCAACACTTTGTTATTGGTCAATTTGTCTAGTAGTAAATTTCCAATACTACCCGTGTCCC
                      1210       1220       1230       1240       1250       1260       1270       1280       1290       1300       1310       1320

390
               L  S  E  Q  G  G  S  H  H  H  H  H  H  *  *
               GTTAAGCGCAAGGTTGTTCACATCATGTTCACATCATCATCATCATTAATGAAAGGCCGATATCCAGCACTGGCCGGCCGTTACTAGTGGATCCGGCTGCTAACAAAGCCCGAAAGGAAGCTGAG
               CAATTCGCTGCTCGTTCCACCAAGTGTAGTAGTAGTAGTAGTAATTACTTTCCCGCTATAGGTCGTGACCGGCCGGCAATGATCACCTAGGCCGACGATTGTTCGGCCTTCCTTCGACTC
                         1330       1340       1350       1360       1370       1380       1390       1400       1410       1420       1430       1440

TTGGCTGCTGCCACCGCTGCAGCAATAACTAGCATAACCCCTTTGGGCCTCTAAACGGGTTCTTGAGGGGTTTTTTTGCTGAAAGAGGAACTATATCCGGAGGACTCCCACGGCACGTTGG
               AACCGACGACGGTGGCGACTCGTTATTGATCGTATAGCAATACCCGGAGAAACCCCGGAGAGATTTGCCCAGAACTCCCAGAAAAAACGACTTTCCTCCTTGATATAGCCCTGCCTGAGGGTGCCGTCAACC
                      1450       1460       1470       1480       1490       1500       1510       1520       1530       1540       1550       1560

CAAGCTCGGAATTCGGCGTAATC
               GTTCGAGCCTTAAGCCGCATTAG
                      1570       1580

FIG. 45 (Continued)
```

FIG. 46 - Exemplary Expression Construct for csUBP7_211C

```
       270                 280                 290                 300
V D T P E N K E F V E K Y K K K Y G E D R V T D D P I E A A Y I G V V Y L W A K A
TGTAGATACACCGGAAAACAAGGAGTTCGTTGAGAAATATAAGAAAAAGTATGGGGAGGACCGGGTGACAGATGACCCAATCGAGGCGGCATACATCGGCGTATACTTATGGGCTAAAGC
ACATCTATGTGGCCTTTGTTCCTCAAGCAACTCTTTATATTCTTTTCTAAGCTCGTCGCCACTGTCTACTGGGTTAGCTCCGCCGTATGTAGCCGCATATGAATACCCGATTCG
       970         980         990        1000        1010        1020        1030        1040        1050        1060        1070        1080

310                 320                 330                 340
V E K A G S T D V D K V R E A A K G I E F N A P E G P V K I D G D N Q H L Y K T
GGTTGAGAAGGCGGGGTCGACAGACGTGGATAAGGTCCGGGAGGCATCGAATTTAACGCCCGAGGGGCCCAGTGTAAAGATTGACGGCGACAACCAGCACCTCTACAAGAC
CCAACTCTTCCGCCCCAGCTGTCTGCACCTATTCGAGCCCTCCGGGCCTTAAATTGCGGAGGGCTCCCGGGTCATTTCTAACTGCGTGTTGGTCGTTGGAGATGTTCTG
      1090        1100        1110        1120        1130        1140        1150        1160        1170        1180        1190        1200

350                 360                 370                 380
V R I G E I L E N G Q I R E L W K T N K P V K P D P Y L K G Y E W A Q G L S E Q
GGTGCGTATTCGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCA
CCACGCATAAGCACTCTAGGACCTCTTGCCAGTTTAAGCACTCAACACCCTTTTGTTTATTTGTCTAGTATAAATTTTCCAATACTACCCGTGTCCCAATTCGCTCGT
      1210        1220        1230        1240        1250        1260        1270        1280        1290        1300        1310        1320

390
G G S H H H H H H * * *
AGTGGTTCACATCATCATCATCATCATTAATGAAAGGGCGATATCCAGCACTGGCGCCGTTACTAGTGGATCCTGCTCTAACAAAGCCCGAAAGGAAGCTGAGTTGGCTGCTGCC
TCCACCAAGTCGTAGTAGTAGTAGTAGTAATTACTTTCCGCTATAGGTCGTGTGACCGCCAATGATCACCTAGGCGACGATTGTTTCGGCTTTCTTCGACTGTTCGAACCGACGACGG
      1330        1340        1350        1360        1370        1380        1390        1400        1410        1420        1430        1440

ACCGCTGAGCAATAACTAGCATAACCCCTTGGGGCCTCTAAACGGGTCTTGAGGGTTTTTTGCTGAAAGGAGGAACTATATCCGGAGCGACTCCCACGGCACGTTGGCAAGCTCG
TGGCCGACTCGTTATTGATCGTATTGGGGAACCCCGGAGATTTGCCCAGAACTCCCCAAAAAACGACTTTCCTCCTTGATATAGGCCTCGCTGAGGGTGCCGTGCAACCGTTCGAGC
      1450        1460        1470        1480        1490        1500        1510        1520        1530        1540        1550
```

FIG. 46 (Continued)

FIG. 47 - Exemplary Expression Construct for csUBP7_238C

```
                                    270                           280                           290                           300
      V  D  T  P  E  N  K  E  F  V  E  K  Y  K  K  K  Y  G  E  D  R  V  T  D  D  P  I  E  A  A  Y  I  G  V  V  Y  L  W  A  K  A
      TGTAGATACACCGGAAAAACAAGGAGTTCGTTGAGAAATATAAGAAAAAAGTATGGGAGGACCGGCTGACAGATGACCCAATCGAGGCGGCATACATCGGCGTATACTTATGGGCTAAAGC
      ACATCTATGTGGCCTTTTGTTCCTCAAGCAACTCTTTATATTCTTTTCATACCCCTCCTGGCCCACTGTCTACTGGGTTAGCTCCGCCGTATGTAGCCGCATAATGAATACCCGATTTCG
          970           980           990          1000          1010          1020          1030          1040          1050          1060          1070          1080

310                           320                           330                           340
      V  E  K  A  G  S  T  D  V  D  K  V  R  E  A  A  K  G  I  E  F  N  A  P  E  G  P  V  K  I  D  G  D  N  Q  H  L  Y  K  T
      GGTTGAGAAGGCGGGGTCGACAGACGTGGATAAGGTCCGGGAGGCATCGAATTTAACGCCCAGAGGGCCCAGTAAAGATTGACGGCGACAACCAGCACCTCTACAAGAC
      CCAACTCTTCCGCCCCAGCTGTCTGCACCTATTCGAGGCCCTCCGGCCTTCCCGTAGCTTAAATTGCGGAGTCTCCCGGGTCATTTCTAACTGCGCTGTTGGTCGTTGGAGATGTTCTG
          1090          1100          1110          1120          1130          1140          1150          1160          1170          1180          1190          1200

350                           360                           370                           380
      V  R  I  G  E  I  L  E  N  G  Q  I  R  E  L  W  K  T  N  K  P  V  K  P  D  P  Y  L  K  G  Y  E  W  A  Q  G  L  S  E  Q
      GGTGCGTATTGGTGAGATCCTGGAGAACGGTCAAATTCGTGAGTTGTGGAAAACAAATAACCAGTTAAACCAGATCCATATTTAAAAGGTTATGAATGGGCACAGGGGTTAAGCGAGCA
      CCACGCATAACCACTCTAGGACCTCTTGCCAGTTTAAGCACTCAACACCCTTTGTTTATTGGTCTAGTATATAAATTTTCCAATACTACCCGTGTCCCCAATTCGTGTCCCAATTCGCGT
          1210          1220          1230          1240          1250          1260          1270          1280          1290          1300          1310          1320

390
      G  G  S  H  H  H  H  H  H  *  *  *
      AGTGGTTCACATCATCATCATCATTAATGAAAGGGCGATATCCAGCACACTGCGGCCGTTACTAGTGGATCCGGCTGCTCCTAACAAAGCCCGAAAGGAAGCTGAGTTGGCTGCTGCC
      TCCACCAAGTGTAGTAGTAGTAGTAATTACTTTCCCGCTATAGGTCGTGTGACCGCCGGCAATGATCACCTAGGCCGACGATTGTTTCGGGCTTTCCTTCGACTGTTCGACTCAACGACGACGG
          1330          1340          1350          1360          1370          1380          1390          1400          1410          1420          1430          1440

ACCGCTGAGCAATAACTAGCATAACCCCTTGGGGCCTCTAAACGGGTCTTGAGGGTTTTTTTGCTGAAAGGAGGAACTATATCCGGAGGCGACTCCCACGGCACGTTGGCAAGCTCG
      TGGCGACTCGTTATTGATCGTATTGGGGAACCCCGGAGATTTGCCCAGAACTCCCCAAAAACGACTTTCCTCCTTGATATAGGCCTGCTGCCTGAGGGTGCCGTGCAACCGTTCGAGC
          1450          1460          1470          1480          1490          1500          1510          1520          1530          1540          1550
```

FIG. 47 (Continued)

FIG. 48 - Exemplary Expression Construct for bsUBP3_76C

```
AAGCTTCGGTCACGCTTGGGACTGCCATAGGCTGCCCGGTGATGCCGGCCACGATGCGTCCGGCGTAGAGGATCGATCCCGGCGTAGAGGATCTCGATCCCGGAAATTAATACGACTCACTATAGGGAGAC
TTCGAAGCCAGTGCGAACCCTGACGGTATCCGACGGGCCACTACGGCCAGGCCGGTGCTACGACGATCTCCTAGAGCTAGGGCGCTTTAATTATGCTGAGTGATATCCCTCTG
        10        20        30        40        50        60        70        80        90        100       110       120
                                                                                   M  K  V  G  I  L  H  S  L  S  G  T  M  A  I  S  E  V  S  V  H  D
CACAAACGGTTCCCCTCTAGAAATAATTTGTTTAACTTTAAGAAGAGATATACCATGAAAGTAGGCATTTTGCATTCTTTATCAGTGACATGGCAATCTCGGAAGTAAGTGTTCACGA
GTGTTGCCAAAGGGAGATCTTTATTAAACAAATTGAAATTCTTCTCTATATGGTACTTTCATCCGTAAAACGTAAAACGTAGTGCACTGTACCATGTTCATTCACAAGTGCT
        130       140       150       160       170       180       190       200       210       220       230       240
           30                                  40                                 50                                   60
 A  E  L  I  A  I  Q  E  I  N  Q  K  G  G  V  L  G  K  K  L  E  P  V  V  E  D  G  A  S  D  W  P  T  Y  A  E  K  M  R  K
CGCCGAGCTCATTGCGATCCAAGAAATCAATCAGAAGGGGGTGCTCGGTAAGAAACTCGAACCGGTAGTGGAAGATGGCATCCGACTGGCCTACATATGCAGAGAAATGCGAA
GCGGCTCGAGTAACGCTAGGTTGTTTAGTTGTCTTCCCCCACAGAGCCATTCTTTGAGCTTGGCCATCACTTCTACCACGTAGGCTGACCGGATGTATACGTCTCTTTACGCCTT
        250       260       270       280       290       300       310       320       330       340       350       360
                      70                                 80                                  90                                100
 L  L  Q  Q  D  K  V  A  A  V  F  G  G  C  T  S  A  S  R  K  A  M  L  P  V  V  E  Q  N  N  G  L  L  F  Y  P  V  Q  Y  E
GCTCTTACAGCAGGATAAAGTAGCAGCAGTATTCGGCGGGTGTACCTCCGCGTCCCGTAAGGCAATGCTTCCAGTAGTCGAGCAAATAACGGGCTCTATTTACCAGTCCAGTACGA
CGAGAATGTCGTCCTATTTCATCGTCGTCATAAGCCGCCCACATGGAGGCACGGCATCCGTTACGAAGGTCATCAGCTTCGTTTATGCCCGAGAATAAATGGGTCAGGTCATGCT
        370       380       390       400       410       420       430       440       450       460       470       480
                                      110                                130                                 140
 G  M  E  T  S  P  N  I  F  Y  T  G  A  T  T  N  Q  Q  I  V  P  A  V  D  W  L  L  K  N  K  G  K  K  F  F  L  I  G  S  D
AGGGATGGAGACATCGCCAAATATCTTCTATACTGGTGCAACAACAAATCGTCCCAGCCGTAGATTGGCTTTGAAGAATAAAGGGAAAAAATTCTTCCTCATCGGTAGTGA
TCCCTACCTCTGTAGCGGTTGTAGCGGTTGTCATAAGAGTAATAGCTAATAGTTCGAAAACTTCTTATTCTCCTTTTTAAGAAGGAGTAGCCATCACT
        490       500       510       520       530       540       550       560       570       580       590       600
                      150                                 160                                170                                180
 Y  V  F  P  R  T  A  N  K  I  I  K  A  Q  V  K  A  G  G  E  I  A  G  E  E  Y  T  P  L  G  H  T  N  Y  S  T  L  V  S
CTACGTCTTCCCGCGTACCGCCAACAAGATTATCAAAGCCCAGGTGCAAAGCTCGAAGGAGTACACCCCATTGGGCCACACTAATTATTCAACACTGGTATC
GATGCAGAAGGGCATGGCGGTTGTTCTAATAGTTCGGGTCCACGTTTCGAGCTTCCTCATGTGGGGTAACCCGGTGAAGAAATTCGTGCGAGTCATGAGAGTGTGAACATAG
        610       620       630       640       650       660       670       680       690       700       710       720
                                      190                                 200                                210                                220
 K  I  K  E  K  Q  P  D  V  I  F  N  T  L  N  G  D  S  N  V  A  F  F  K  Q  L  K  D  A  G  I  S  A  D  D  M  P  V  M  S
CAAAATCAAGGAAAAACAACCAGATGTAATCTTTAATACACTCAACGGGGACTCTAACGTTGCCTTCTTTAAGCAGCTCAAGGATGCAGGATCAGCGCTGACGATATGCCGGTAATGAG
GTTTTAGTTCCTTTTTGTTGGTCTACATTAGAATTATGTGAGTTGCCCCTGAGATTGCAACGGAAGAAATTCGTCGAGTTCCTACGTGCGACTGTATCCTGTGACCATAG
        730       740       750       760       770       780       790       800       810       820       830       840
                          230                                 240                                250                                260
 A  S  V  A  E  E  E  I  R  G  I  G  P  D  V  L  K  G  H  Y  A  V  W  N  Y  F  Q  T  T  N  T  S  E  N  Q  T  F  V  K  N
CGCATCTGTCGCCGAGGAGGAGATCCGGGGATTGGGCCAGACGTACTCAAGGGGCATTATGCCGTGTGAACTACTAACACCAGTGAAACATTTCAAAA
GCGTAGACAGCGGCTCCTCCTCCTAGGCCCTAACCCCGGTCTGCATGAGTTCCCCGTAATAACGGCACACCTTGATGAAAGTTTGATGATTGGTCACTCTTGGTTTTTTGTAAGCAGTTTT
        850       860       870       880       890       900       910       920       930       940       950       960
```

```
          270              280                290                300
Y K K M N G D S R V T S D P I E A G Y N A V V Y L W A A A V E K A K S F D V D K V
TTATAAAAGATGAACGGTGACAGCCGCGTAACTAGCGATCCAATTGAGGCCGGGTATAACGCAGTCTATCTCTGGGCGGCCGCAGTAGAAAAAGCTAAGAGTTTTGACGTGGACAAGGT
AATATTTTCTACTTGCCACTGTCGCACTTGCCGGCGCATTGATCGCTAGGTTAACTCCGGCCGCCATATTGCGTCAGATAGAGACCCGCGGCTGTCATCTTTTCGATTCTCAAAACTGCCACCTGTTCCA
    970     980     990    1000    1010    1020    1030    1040    1050    1060    1070    1080
          310              320                330                340
K K A A D G I S F K A P G G T V K I D G D T Q H L Y K T V R I G Q I T G D G Q F
CAAGAAAGCCGCAGATGGTATTAGTTTCAAGGCCCCAGGTGGCACCGTAAAGATCGATGGTGATACTCAGCACTTATATAAGACCGTACGCATCGGGCAGATTACGGGGATGGTCAGTT
GTTCTTTCGGCCGTCTACCATAATCAAAGTTCCGGGGTCCACCGTGGCATTTCTAGCTACCACTATGAGTCGTGAATATATTCTGGCATGCGTAGCCCGTCTAATGCCCCTACCAGTCAA
    1090    1100    1110    1120    1130    1140    1150    1160    1170    1180    1190    1200
          350              360                370                380
K E V W N S G E P V K P D P Y L K T Y D W A K G L S K G G S H H H H H H * *
CAAAGAGGTATGGAATAGTCGTGAACCAGTGAAGCCAGATCCGTATTTGAAGACCTATGATTGGGCAAAGGGCCTCTCAAAGTGGTTCACATCATCATCATCATTAATGAAAGGG
GTTTCTCCATACCTTATCACCACTTGGCTAGCTCCGGTCTAGGCCATAAACTTCTGGATACTAACCGTATACTTGGACTCAACCGACGACGCGTGGCGACTCGTATTGATCGTATTGGGAACCCCGAGA
    1210    1220    1230    1240    1250    1260    1270    1280    1290    1300    1310    1320

CGATATCCAGCACACTGGCGCCGTTACTAGTGGATCCGGCTGCTAACAAAGCCCGAAAGAAGCTGAGTTGCTGCTCGCCACCGCTGAGCAATAACTAGCATAACCCCTTGGGCCTCT
GCTATAGGTCGTGTGACCGCCGGCCAATGATCACCTAGGCCGACGATTGTTTCGGGCCTTCGACTCAACGACGAGCTGGCCGACTCGTATTGATCGTATTGGGAACCCCGAGA
    1330    1340    1350    1360    1370    1380    1390    1400    1410    1420    1430    1440

AAACGGGTCTTGAGGGGTTTTTGCTGAAAGGAGAACTATATCCGAGCGACTCCCACGGCACGTTGGCAAGCTCGGAATTC
TTTGCCCAGAACTCCCAAAAAACGACTTTCCTCCTTGATATAGGCCTCGCCGTGCCGTGAGGGTGCCGTGCAACCGTTCGAGCCTTAAG
    1450    1460    1470    1480    1490    1500    1510    1520
```

FIG. 48 (Continued)

FIG. 49 - Exemplary Expression Construct for bsUBP3_77C

FIG. 49 (Continued)

FIG. 50 - Exemplary Expression Construct for bsUBP3_78C

```
AAGCTTCGGTCACGCTTGGGACTGCCATAGGCTGCCCGGTGATGCCGGCCACGATGCGTCCGGCGTAGAGGATCGAGATCTCGATCCCGGCGTAGAGGAGAC
TTCGAAGCCAGTGCGAACCCTGACGGTATCCGACGGGTGCTACGCCAGGCCCGCATCTCTAGAGCTCTAGAGCGCTTTAATTATGCTGAGTATATCCCTCTG
         10        20        30        40        50        60        70        80        90       100       110       120
                                                                              M  K  V  G  I  L  H  S  L  S  G  T  M  A  I  S  E  V  S  V  H  D
                                                                                                                    10                      20
CACAAACGGTTTCCCTCTAGAAATATTTGTTTAACTTTAAGAAGAGAGATATACCATGAAAGTAGGCATTTTGCATTCTTATCAGTGACAATCTCGGAAGTAAGTGTTCACGA
GTGTTGCCAAAGGGAGATCTTATTTAAACAATTGAAATTCTTCCTATATGGTACTTTCATCCGTAAAACGTAAGAATAGTCCACTGTTAGAGCCTTCATTCACAAGTGCT
        130       140       150       160       170       180       190       200       210       220       230       240
 M  K  V  G  I  L  H  S  L  S  G  T  M  A  I  S  E  V  S  V  H  D
 A  E  L  I  A  I  Q  E  I  N  Q  K  G  G  V  L  G  K  K  L  E  P  V  V  E  D  G  A  S  D  W  P  T  Y  A  E  K  M  R  K
                30                      40                      50                      60
CGCCGAGCTCATTGCGATCCAAGAAATCAATCAGAAGGGGGTGCTCGGTAAGAAACTCGAACCGGTAGTGGAAGATGGCATCGACTGGCCTACATATGCAGAGAAAATGCGAA
GCGGCTCGAGTAACGCTAGGTTCTTTAGTTAGTCTTCCCCCACAGAGCCATTCTTTGAGCTTGGCCATCACCTTCTACGAGTGGATGTATACGTCTCTTTACGCCTT
        250       260       270       280       290       300       310       320       330       340       350       360
 L  L  Q  Q  D  K  V  A  A  V  F  G  G  W  T  C  A  S  R  K  A  M  L  P  V  V  E  Q  N  N  G  L  L  F  Y  P  V  Q  Y  E
                70                      80                      90                     100
GCTCTTACAGCCAGGATAAAGTAGCAGCAGTATTCGGCGGGTGGACCTGTGCCTCCCGTAAGGCCAATGCTTCCAGTAGTCGAGCCAAATAACGGGCTCTTATTTTACCGAGTCCAGTACGA
CGAGAATGTCGGTCCTATTTCATCGTCGTCATAAGCCGCCCACTGGACACGGAGTCACCATCCGTTACGAAGGTCATCAGCTCGGAGAATAAAATGGGTCAGGTCATGCT
        370       380       390       400       410       420       430       440       450       460       470       480
 G  M  E  T  S  P  N  I  F  Y  T  G  A  T  T  N  Q  Q  I  V  P  A  V  D  W  L  L  K  N  K  G  K  K  F  F  L  I  G  S  D
                110                     120                     130                     140
AGGGATGGAGACATCGCCAAATATCTTCTATACTGGTGCAACAACAACAACCAACAAATCGTCCCAGCCGTAGATTGGCTTTGAAGAATAAAGGCAAAAAATTCTTCCTCATCGGTAGTGA
TCCCTACCTCTGTAGCGGTTGTTCATAGAAGATATGACCACGTTGTTGTTGTTGTTTAGCAGGTCGGCATCTAACCGAAACTTCTTATTTCCCTTTTTTAAGAAGGAGTAGCCATCACT
        490       500       510       520       530       540       550       560       570       580       590       600
 Y  V  F  P  R  T  A  N  K  I  I  K  A  Q  V  K  A  G  G  E  I  A  G  E  E  Y  T  P  L  G  H  T  N  Y  S  T  L  V  S
                150                     160                     170                     180
CTACGTCTTCCCGGTACCGCCAACAACCAGGATTATCAAAGCCCAGTCAAGTTGCGGGTGAGGAGTACACCCATTGGGCCACACTGGCCACACTAATTATTCAACACTGGTATC
GATGCAGAAGGGCCATGGCGGTTGTTCATCATCTATAGTTCGGGGTCAGTTCGCCACTCCCTCATGGGGTAACCCGGGTAACTCCGTGATTAATAAGTTGTGACCATAG
        610       620       630       640       650       660       670       680       690       700       710       720
 K  I  K  E  K  Q  P  D  V  I  F  N  T  L  N  G  D  S  N  V  A  F  F  K  Q  L  K  D  A  G  I  S  A  D  D  M  P  V  M  S
                190                     200                     210                     220
CAAAATCAAGGAAAAACAACCAGGATGTAATCTTTAATACACTCAACGGGGACTTGCCTTCTTAAGCAGTTGCCTTCTTAAGCAGTCAGGATGCAGGATCAGCGCTGACGATATGCCGGTAATGAG
GTTTTAGTTCCTTTTTGTTGGTCCTACATTAGAAATATTGTGAGTTGCAACGGAAGAATTCGTCGAGTGATTAATAAGTTGTGACCATTC
        730       740       750       760       770       780       790       800       810       820       830       840
 A  S  V  A  E  E  E  I  R  G  I  G  P  D  V  L  K  G  H  Y  A  V  W  N  Y  F  Q  T  T  N  T  S  E  N  Q  T  F  V  K  N
                230                     240                     250                     260
CGCATCTGTCGCCGAGGAGGAGATCCGGGGGATTGGGCCAGATGGCCAGACGTACTCAAGGGCATTATGCCGTGTGAACTACTTTCAAACTACTAACACCAGTGAGAACCAAACATTCGTCAAAAA
GCGTAGACAGCGGCTCCTCCTCTAGGCTAGGCCCCCTAACCCGGTCTGCATGAGTTCCCGTAATACGGCACACCTTGATGAAAGTTTGATGATTGGTGACTCTTGGTTTGTTAAGCAGTTTT
        850       860       870       880       890       900       910       920       930       940       950       960
```

```
                    270                       280                       290                       300
Y   K   K   M   N   G   D   S   R   V   T   S   D   P   I   E   A   G   Y   N   A   V   V   Y   L   W   A   A   A   V   E   K   A   K   S   F   D   V   D   K   V
TTATAAAAAGATGAACGGTGACAGCCGTAACTAGCGATCCAAATTGAGGCCGGGTATAACGCAGTCTATCTCTGGGCGGCCGCAGTAGAAAAAGCTAAGAGTTTTGACGTGGACAAGGT
AATATTTTCTACTTGCCACTGTCGGCAGCATTGATCGCTAGGTTAACTCCGGCCCATATTGCGTCAGATAGAGACCCGTCATCTTTTCGATTCTCAAAACTGCACCTGTTCCA
970         980         990         1000        1010        1020        1030        1040        1050        1060        1070        1080
                    310                       320                       330                       340
K   K   A   A   D   G   I   S   F   K   A   P   G   G   T   V   K   I   D   G   D   T   Q   H   L   Y   K   T   V   R   I   G   Q   I   T   G   D   G   Q   F
CAAGAAAGCCGCAGATGGTATTAGTTTCAAGGCCCCAGGTGGCACCGTAAAGATCGATGGTGATACTCAGCACTTATATAAGACCGTACGCATCGGGCAGATTACGGGGATGGTCAGTT
GTTCTTTCGGCCGTCTACCATAATCAAAGTTCCGGGGTCCACCGTGGCATTTCTAGCTACCACTATGAGTCGTGAATATATTCTGGCATGCGTAGCCGTCTAATGCCCCTACCAGTCAA
1090        1100        1110        1120        1130        1140        1150        1160        1170        1180        1190        1200
                    350                       360                       370                       380
K   E   V   W   N   S   G   E   P   V   K   P   D   P   Y   L   K   T   Y   D   W   A   K   G   L   S   K   G   G   S   H   H   H   H   H   H   *   *
CAAAGAGGTATGGAATAGTCGTGAACCAGTGGAAGCCAGATCCGTATTTGAAGACCTGATTGGGCAAAGGGCCCTCTCCAAAGTGGTTCACATCATCATCATCATTAATGAAAGGG
GTTTCTCCATACCTTATCGCACTTGCGTCACTTCGGTCTAGCCATAACTCTGATACTAACTTCTGACTAACCCGTTTCCCGGAGAGTTTCCACCAAGTGTAGTAGTAGTAGTAATTACTTTCCC
1210        1220        1230        1240        1250        1260        1270        1280        1290        1300        1310        1320

CGATATCCAGCACACTGGCGCCGTTACTAGTGGATCCGGCTGCTAACAAAGCCCGAAAGAAGCTGAGTTGGCTGCTGCTGCCACCGCTGAGCAATAACTAGCATAACCCCTTGGGCCTCT
GCTATAGGTCGTGTGACCGCCGGCCAATGATCACCTAGGCCGACGATTGTTTCGGGCTTTCGACTCAACCGACGACGGTGGCGACTCGTATTGATCGTATTGGGAACCCCGGAGA
1330        1340        1350        1360        1370        1380        1390        1400        1410        1420        1430        1440

AAACGGGTCTTGAGGGGTTTTTTGCTGAAAGGAGGAACTATATCCGAGCGACTCCCACGGCACGTTGGCAAGCTCGGAATTC
TTTGCCCAGAACTCCCCAAAAAACGACTTTCCTCCTTGATATAGGCCTTGCTGAGGGTGCCGTGCAACCGTTCGAGCCTTAAG
1450        1460        1470        1480        1490        1500        1510        1520
```

FIG. 50 (Continued)

FIG. 51 - Exemplary Expression Construct for bsUBP3_79C

```
AAGCTTCGGTCACGCTTGGGACTGCCATAGGCTGGCCCGGTGATGCGGCCACGATGCGTCCGGCGTAGAGGATCGAGATCTCGATCCCGGCGTAGAGGATCTTCGATCCCGGAAATTAATACGACTCACTATAGGAGAC
TTCGAAGCAGTGCGAACCCTGACGGTATCCGACCGGGCCACTACGGCCCGGTGCTACGCAGGCCGCATCTCTAGAGCTCTAGGGCGCTTTAATTATGCTGAGTGATATCCCTCTG
          10        20        30        40        50        60        70        80        90        100       110       120
                                                                                       M   K   V   G   I   L   H   S   L   S   G   T   M   A   I   S   E   V   S   V   H   D
                                                                                                                                       10                                    20
CACAACGGTTCCCTCTAGAATCTTAAGAAGAGATATACCATGAAAGTAGGCATTTTGCATTCTTTATCAGTACCATGGCAATCTCGGAAGTAAGTGTTCACGA
GTGTTGCCAAAGGAGATCTTAGAATTCTTCTCTATATGGTACTTTCATGGGTAAAACGTAAGAAATAGTCCATGGTACCGTTAGAGCCTTCATTCACAAGTGCT
          130       140       150       160       170       180       190       200       210       220       230       240
A   E   L   I   A   I   Q   E   I   N   Q   K   G   G   V   L   G   K   K   L   E   P   V   V   E   D   G   A   S   D   W   P   T   Y   A   E   K   M   R   K
                    30                                      40                                      50                                      60
CGCCGAGCTCATTGCGATCCAAGAAATCAATCAGAAGGGTGTCCTCGGTAAGAAACTCGAACCGGTAGTGGAAGATGGCATCGACTGGCCTACATATGCAGAGAAAATGCGAA
GCGGCTCGAGTAACGCTAGGTTCTTTAGTTAGTCTTCCCCACAGAGGAGCCATTCTTTGAGCTTGGCCATCACTTCTACCACGTAGGCTGACGGATGTATACGTCTCTTTACGCCTT
          250       260       270       280       290       300       310       320       330       340       350       360
L   L   Q   Q   D   K   V   A   A   V   F   G   G   W   T   S   C   S   R   K   A   M   L   P   V   V   E   Q   N   N   G   L   L   F   Y   P   V   Q   Y   E
                    70                                      80                                      90                                      100
GCTCTTACAGCCAGGATAAAGTAGCAGCAGTATTCGGCGGGTGACCTTCCCAGTAGCTTCCGTAAGGCAATGCTTCCAGTAGTCGAGCAAATAACGGGCTCTATTTTACCCAGTCCAGTACGA
CGAGAATGTCGTCCTATTTCATCGTCGTCATAAGCCGCCCACTGGAAGCGTCATCAGCTTACGAAGGTCATCACGTTTATTGCCCCAGAATAAAATGGGTCAGTGTCATGCT
          370       380       390       400       410       420       430       440       450       460       470       480
G   M   E   T   S   P   N   I   F   Y   T   G   A   T   T   N   Q   Q   I   V   P   A   V   D   W   L   L   K   N   K   G   K   K   F   F   L   I   G   S   D
                    110                                     120                                     130                                     140
AGGGATGGAGACATCGCCAAATATCTTCTATACTGGTGCAACAACAACAAACAAATCGTCCCAGCCGTAGATTGGCTTTGAAGAATAAAGGGCAAAAATTCTTCCTCATCGGTAGTGA
TCCCTACCCTCGTAGCGGTTGTTGTTTATAGAAGATATGACCACGTTGTTGTTGGTTAGTACAAGCATCTTAACCGAAACTTCTTATTTCCCTTTTTTAAGAAGGAGTAGCCATCACT
          490       500       510       520       530       540       550       560       570       580       590       600
Y   V   F   P   R   T   A   N   K   I   I   K   A   Q   V   K   A   G   G   G   E   I   A   G   E   E   Y   T   P   L   G   H   T   N   Y   S   T   L   V   S
                    150                                     160                                     170                                     180
CTACGTCTTCCCGGTACCGCCAACAACGATTATCAAAGCCCAGTGCAAAGCCTCAAAGCTCAACGTTGCCTTCTTTAAGCAGCTCAAGGATGCAGGATGAGTACACCCCATTGGGCCACACTGGTATC
GATGCAGAAGGGCCATGGCGGTTGTTCTATAATAGTTTCGGGTGTTCGAGTTCCACAGTTTCGCCCGAACTCGCAGTCCGCGATTAATAAGTTGTGACCATAG
          610       620       630       640       650       660       670       680       690       700       710       720
K   I   K   E   K   Q   P   D   V   I   F   N   T   L   N   G   D   S   N   V   A   F   F   K   Q   L   K   D   A   G   I   S   A   D   D   M   P   V   M   S
                    190                                     200                                     210                                     220
CAAAATCAAGGAAAAACAACCAGATGTAATCTTTAATACACTCAACGGGGACTTGCCTTCTTTAAGCAGTTGCAACGAAGAAATTCGTCGAGTTCTGCGACTGCTATACGGCCATTACTTC
GTTTTAGTTCCTTTTGTTGGTCTACATTAGAAATATGTGAGTTGCCCTGAACGGAAGAAATTTCGTCAACTGCGACCACCTTAATGGGAAATTTGATGATTGGTCACTCTTGGTTTGTAAGCAGTTTT
          730       740       750       760       770       780       790       800       810       820       830       840
A   S   V   A   E   E   E   I   R   G   I   G   P   D   V   L   K   G   H   Y   A   V   W   N   Y   F   Q   T   T   N   T   S   E   N   Q   T   F   V   K   N
                    230                                     240                                     250                                     260
CGCATCTGTCGCCGAGGAGGAGATCCGGGGATTGGGCCAGGACGTACTCAAGGGCATTATGCCGTGTGAACTACTTCAAACTACTAACACCAGTGAGAACCAGTGAAATTCGTCAAAAA
GCGTAGACAGCGGCTCCTCCTCTAGGAGCCCTAAGCCGGTCTGCATGAGTTCCCGTAATAACGGCACACCTTTGATGAAAGTTTGATGATTGGTCACTCTTGGTTTGTAAGCAGTTTT
          850       860       870       880       890       900       910       920       930       940       950       960
```

```
        Y  K  K  M  N  G  D  S  R  V  T  S  D  P  I  E  A  G  Y  N  A  V  V  Y  L  W  A  A  A  V  E  K  A  K  S  F  D  V  D  K  V
                          270                         280                         290                         300
TTATAAAAGATGAACGGTGACAGCCGTGTAACTAGCGATCCAAATTGAGGCCGGGTATAACGCAGTCTATCTCTGGGCGGCCCGCAGTAGAAAAAGCTAAGAGTTTTGACGTGGACAAGGT
AATATTTTCTACTTGCCACTGTCGGCGCACATTGATCGCTAGGTTAACTTGCGTCAGATAGAGACCCGTCATCTTTTCGATTCTCAAAACTGCCACCTGTTCCA
         970        980        990       1000       1010       1020       1030       1040       1050       1060       1070       1080
        K  K  A  A  D  G  I  S  F  K  A  P  G  G  T  V  K  I  D  G  D  T  Q  H  L  Y  K  T  V  R  I  G  Q  I  T  G  D  G  Q  F
                          310                         320                         330                         340
CAAGAAAAGCCGCAGATGGTATTAGTTTCAAGGCCCCAGGTGGCACCGTAAAGATCGATGGTGATACTCAGCACTTATATAAGACCGTACGCATCGGGCAGATTACGGGGATGGTCAGTT
GTTCTTTTCGGCCGTCTACCATAATCAAAGTTCCGGGGTCCACCGTGGCATTTCTAGCTACCACTATGAGTCGTGAATATATTCTGGCATGCCCGTCTAAATGCCCCTACCAGTCAA
        1090       1100       1110       1120       1130       1140       1150       1160       1170       1180       1190       1200
        K  E  V  W  N  S  G  E  P  V  K  P  D  P  Y  L  K  T  Y  D  W  A  K  G  L  S  K  G  G  S  H  H  H  H  H  H  *  *
                          350                         360                         370                         380
CAAAGAGGTATGGAATAGTCGTGAACCAGTGAAGCCAGATCCGTATTTGAAGACCTATGATTGGGCAAAGGGCCTCTCAAAGTGGTTCACATCATCATCATCATTAATGAAAGGG
GTTTCTCCATACCTTATCGCACACTTGGTCACTTCGGTCTAGCCATAAACTTCTGATACTAACCCGTTTCCCGAGAGTTTCCACCAAGTGTAGTAGTAGTAGTAGTAATTACTTTCCC
        1210       1220       1230       1240       1250       1260       1270       1280       1290       1300       1310       1320
CGATATCCAGCACACTGGCGCCGTTACTAGTGGATCCGGCTGCTAACAAAGCCCGAAAGAAGCTGAGTTGGCTGCTGCTGCCACCGCTGAGCAATAACTAGCATAACCCCTTGGGCCTCT
GCTATAGGTCGTGTGACCGCCGGCCAATGATCACCTAGGCCGATTGTTTCGGGCTTTCTTCGACTCAACGACGACGGTGGCGACTCGTATTGATCGTATTGGGAACCCCGGAGA
        1330       1340       1350       1360       1370       1380       1390       1400       1410       1420       1430       1440
AAACGGGTCTTTGAGGGGTTTTTTGCTGAAAGGAGGAACTATATCCGAGCGACTCCCACGGCACGTTGGCAAGCTCGGAATTC
TTTGCCCAGAACTCCCAAAAAACGACTTTCCTCCTTGATATAGGCCTGCTGAGGGGTGCCGTGCAACCGTTCGAGCCTTAAG
        1450       1460       1470       1480       1490       1500       1510       1520

FIG. 51 (Continued)
```

FIG. 52 - Exemplary Expression Construct for bsUBP3_145C

```
              270         Y K K M N G D S R V T S D P I E A G Y N A V V Y L W A A A V E K A K S F D V D K V
        TTATAAAAAGATGAACGGTGACAGCCGTGACTAGCGATCCAATTGAGGCCGGGTATAACGCAGTCTATCTCTGGGCGCCCAGTAGAAAAAGCTAAGAGTTTTGACGTGGACAAGGT
        AATATTTTCTACTTGCCACTGTCGCACTGATCGCTAGGTTAACTTGCCTCAGATAGAGACCCGTCATCTTTTCGATTCTCAAAACTGCACCTGTTCCA
           970       980       990      1000      1010      1020      1030      1040      1050      1060      1070      1080
              310                                                 330                                            340
        K K A A D G I S F K A P G G T V K I D G D T Q H L Y K T V R I G Q I T G D G Q F
        CAAGAAAGCCGCAGATGGTATTAGTTTCAAGGCCCCAGGTGGCACCGTAAAGATCGATGGTGATACTCAGCACTTATATAAGACCGTCGGGCAGATTACGGGGATGGTCAGTT
        GTTCTTTCGGCCGTCTACCATAATCAAAGTTCCGGGGCATTTCTAGCTACCACTATGAGTCGTGAATATATTCTGGCATGCGTAGCCCGTCTAATGCCCCTACCAGTCAA
          1090      1100      1110      1120      1130      1140      1150      1160      1170      1180      1190      1200
              350                                            370                                           380
        K E V W N S G E P V K P D P Y L K T Y D W A K G L S K G G S H H H H H H * *
        CAAAGAGGTATGGAATAGTCGTGAACCAGTGAAGCCAGATCCGTATTTGAAGACCTATGATTGGGCAAAGGGCCTCTCAAAAGTGGTTCACATCATCATCATCATTAATGAAAGGG
        GTTTCTCCATACCTTATCACCACTTGGTCACTTCGGTCTAGCCATAAACTTCTGGATACTAACCCGTTTCCGGAGAGTTTCCACCAAGTGTAGTAGTAGTAGTAATTACTTTCCC
          1210      1220      1230      1240      1250      1260      1270      1280      1290      1300      1310      1320

CGATATCCAGCACACTGGCGCCGTTACTAGTGGATCCGGCTGCTAACAAAGCCCGAAAGAAGCTGAGTTGCTGCTGCCACCGCTGAGCAATAACTAACCCCTTGGGCCTCT
        GCTATAGGTCGTGTGACCGCCGGCCAATGATCACCTAGGCCGACGATTGTTTCGGCGCTTAACCGACGACGGTGGCGACTCGTATTGATCGTATTGGGAACCCCGGAGA
          1330      1340      1350      1360      1370      1380      1390      1400      1410      1420      1430      1440

AAACGGGTCTTTGAGGGGTTTTTTGCTGAAAGGAGAACTATATCCGAGCGACTCCCACGGCACGTTGGCAAGCTCGGAATTC
        TTTGCCCAGAACTCCCAAAAAACGACTTTCCTCCTTGATATAGGCCTCGCGTGCCGTGCAACCGTTCGAGCCTTAAG
          1450      1460      1470      1480      1490      1500      1510      1520

FIG. 52 (Continued)
```

FIG. 53 - Exemplary Expression Construct for bsUBP3_172C

```
AAGCTTCGGTCACGCTTGGGACTGCCATAGGCTGCCCGGTGATGCCGGCCACGATGCGTCCGGCGTAGAGGATCGAGATTCGATCCCGGCGTAGAGATTAATACGACTCACTATAGGGAGAC
TTCGAAGCCAGTGCGAACCCTGACGGTATCCGACGGGCCACTACGGCCCGGTGCTACGCCAGGCCCGCATCGTCCTAGCTCTAGAGCTAGGGCGCTTTAATTATGCTGAGTGATATCCCTCTG
        10        20        30        40        50        60        70        80        90       100       110       120

M   K   V   G   I   L   H   S   L   S   G   T   M   A   I   S   E   V   S   V   H   D
CACAAACGGTTCCCTCTAGAAATAATTTGTTTAACTTGTAAACAAATTGAAATTCTTCCTATATGTACTTTCAATATGAAAGTAGGCATTTTGCATTCTTTATCAGTGCCTACATATGCCGAAGTAACTCGGAAGTAAGTGTTCACGA
GTGTTGCCAAGGGAGATCTTATTTAAACAAATTGAAATTCTTCCTATATGTACTTTCAATATGAAAGTAGGCATTTTGCATTCTTTATCAGTGCCTACATATGCCGAAGTAACTCGGAAGTAAGTGTTCACGA
       130       140       150       160       170       180       190       200       210       220       230       240

A   E   L   I   A   I   Q   E   I   N   Q   K   G   G   V   L   G   K   K   L   E   P   V   V   E   D   G   A   S   D   W   P   T   Y   A   E   K   M   R   K
CGCCGAGCTCATTGCGATCCAAGAAATCAATCAGAAGGGTGTCCTCGGTAAGAAACTCGAACCGGTAGTGGAAGATGGCATCCGACTGGCCTACATATGCAGAGAAATGCGAA
GCGGCTCGAGTAACGCTAGGTTCTTAGTTAGTCTTCCCCACAGAGCCATTCTTTGAGCTTGGCCATCACCTTCTACCACGTAGGCTGACCGGATGTATACGTCTCTTTTACGCCTT
       250       260       270       280       290       300       310       320       330       340       350       360

L   L   Q   Q   D   K   V   A   A   V   F   G   G   W   T   S   A   S   R   K   A   M   L   P   V   V   E   Q   N   N   G   L   L   F   Y   P   V   Q   Y   E
GCTCTTACAGCCAGGATAAAGTAGCAGCAGTATTCGGCGGGTGGACCTCCAGTGCTTCCAGTAGCCAATGCTTCCAGTAGCTCGAGCCAAATGCTTCCAGTCGACAAATAACGGGCTCTTATTTTACCCAGTCCAGTACGA
CGAGAATGTCGGTCCTATTTCATCGTCGTCATAAGCCGCCCACACTGGAGGTCACGAAGGTCATCAGCTTCCGTTACGAAGGTCATCAGCTTACGAAGGTCATAACGAAGTTTATTGCCCGAGAATAAAATGGGTCAGGTCATGCT
       370       380       390       400       410       420       430       440       450       460       470       480

G   M   E   T   S   P   N   I   F   Y   T   G   A   T   T   N   Q   Q   I   V   P   A   V   D   W   L   L   K   N   K   G   K   K   F   F   L   I   G   S   D
AGGGATGGAGACATCGCCAACTCGCCCAAATATCTTCTATACTGGTGCAACAACAACAACCAACAAATCGTCCCAGCCGTAGATTGGCTTTGAAGAATAAAGGGAAAAATTCTTCCTCATCGGTAGTGA
TCCCTACCCTCGTAGCGGTTGAGCCATGGCCCTTTACGGTAACCGTGTTTAGCGCATCGTAACCGAAACTTCTTATTCCCTTTTTTTAAGAAGGAGTAGCCATCACT
       490       500       510       520       530       540       550       560       570       580       590       600

Y   V   F   P   R   T   A   N   K   I   I   K   A   Q   V   K   A   G   G   E   I   A   G   E   E   Y   T   P   C   G   H   T   N   Y   S   T   L   V   S
CTACGTCTTCCCGCGTACCGCCAACAACAAGATTATCAAAGCCCAGTGCAAAGCTCAAAGCCCAGTTGCGGGTGAGGAGTACACCCCATGTGCCCACACTGGCCACTAATTATTCAACACTGGTATC
GATGCAGAAGGCCATGCCGGTTGTTCATAGTTTCGGGTTCGAGTTCCGCGGCACGTTCGAGACTCCTCATGTGGGGTACACCGGTGTATATAAGTTGTGACCATAG
       610       620       630       640       650       660       670       680       690       700       710       720

K   I   K   E   K   Q   P   D   V   I   F   N   T   L   N   G   D   S   N   V   A   F   F   K   Q   L   K   D   A   G   I   S   A   D   D   M   P   V   M   S
CAAAATCAAGGAAAAACAACCAGATGTAATCTTTAATACACTCAACGGGGACTCTAACGTTGCCTTCTTTAAGCAGCTCAAGGATGCAGGATCAGCGCTGACGATATGCCGGTAATGAG
GTTTTAGTTCCTTTTTGTTGGTCTACATTAGAAATATGTGAGTTGCCCTGAGATTGCAACGGAAGAAATTCGTGCGAGTTCCTACGTCGCTAGTCGGTAGCCATTACTC
       730       740       750       760       770       780       790       800       810       820       830       840

A   S   V   A   E   E   E   I   R   G   I   G   P   D   V   L   K   G   H   Y   A   V   W   N   Y   F   Q   T   T   N   T   S   E   N   Q   T   F   V   K   N
CGCATCTGTCGCCGAGGAGGAGATCCGGGGATTGGGCCAGACGTACTCAAGGGCATTATGCCGTGTGAACTACTTTCAAACTACTAACACCAGTGAGAACCAAACATTCGTCAAAAA
GCGTAGACAGCGGCTCCTCCTCTAGGCCCTAACCCGTCTGCATGAGTTCCCGTAATACGGCACACTTGATGAAAGTTTGATGATTGGTCACTCTTGGTTTGTTAAGCAGTTTTT
       850       860       870       880       890       900       910       920       930       940       950       960
```

FIG. 53 (Continued)

FIG. 54 - Exemplary Expression Construct for ctUBP6_95C

```
         270             280              290              300
 S  W  N  Y  Y  Q  T  T  D  T  P  E  N  K  E  F  V  E  K  Y  K  S  K  Y  G  S  D  R  V  T  D  D  P  I  E  A  A  Y  I  A
TAGTTGGAACTACTACCAAACCACGACACCCCGGAAAATAAGGAGTTCGTCGAGAAGTATAAATCGAAGTATGGGAGCGCGTCACCGATGATCCAATTGAGGCAGCCTACATCGC
ATCAACCTTGATGATGGTTTGGTGGCTGTGGGGCCTTTTATTCCTCAAGCAGCTCTTCAAGCAGCTTCATATTTAGCTTTAATACCCTCGCGCAGTGGCTACTAGGTTAACTCCGTCGGATGTAGCG
            980         990        1000        1010        1020        1030        1040        1050        1060        1070        1080
         310             320              330              340
 V  H  L  W  A  E  A  V  K  K  A  G  S  F  E  V  K  K  V  K  E  A  A  K  G  L  E  F  K  A  P  E  G  L  V  K  I  E  G  E
CGTACACTTATGGGCAGAAGCAGTCAAGAAGCAAGTCAAGAAGCAGGTCGTTTGAAGTAGAGAAAGTGAAAGACCCGCCAAGGCTTAGAGTTTAAAGCCTGAAGGGTTAGTAGTAAAGATCGAGGGGA
GCATGTGAATACCCGTCTCGTCAGTTCGTTCGTCAGTGGCCAGCAAACTTCATCTCTTCCACTTTCTACTTTCTCCGGCGGTTCCGAATCTCAAATTTCGGGACTTCCAATCATTTCTAGCTCCCCT
           1090        1100        1110        1120        1130        1140        1150        1160        1170        1180        1190        1200
         350             360              370              380
 N  Q  H  L  W  K  P  V  R  I  G  E  V  Q  E  D  G  L  I  K  E  I  W  S  T  S  E  A  V  R  P  D  P  Y  L  K  T  Y  D  W
GAATCAGCATCTCTGAAGCCAGTCCGTATTGGTGAAGTACAGGAGGACGGTTTAATCAAGGAGATCTGGTCGACCAGCAGCAGTCCGTCGACCCTTACTTGAAAACTTACGATTG
CTTAGTCGTAGAGACTTCGGTCAGGATAACCACTTCATGTCCTCCTGCCAAATTAGTTCCTCTAGACGCAGCTGGTCGTCAGGCAGCCTGGTCGTCAGGCCTGGAATGAACTTTGAATGCTAAC
           1210        1220        1230        1240        1250        1260        1270        1280        1290        1300        1310        1320
         390
 A  K  G  L  S  D  G  G  S  H  H  H  H  H  H  *
GGCCAAAGGCCTCAGCGATGGGGGTAGTCATCATCATCATCATTAATGAAAGGCCGATATCCAGCAGCACTGGCGCCGTTACTAGTGGATCCGGCTGCTAACAAAGCCCGAAAGAA
CCGGTTTCCGGAGTCGCTACCCCCATCGATCATCATCATCATCAGTAGTAGTAATTACTTTCCGCTATAGTCGTGTGACCGCGGCAATGATCATCAGCCGGACGATTGTTTCGGCCTTTCTT
           1330        1340        1350        1360        1370        1380        1390        1400        1410        1420        1430        1440

GCTGAGTTGGCTGCTGCTGCCAATGCCGCACCGCTGAGCAATAACTAGCATAACCCCTTGGGCCTCTAAACGGTCTTGAGGGTTTTTGCTGAAAGGAGAACTATATCCGGAGCGACTCCCACGGCA
CGACTCAACCGACGACGACGGTTGCCGACTCGTTATTGATCGTATGATTGCCCAGAACTCCCAAAAAACGACTTTCCTCCTTGATATAGGCCTCGCTCGGAGGGTGCCGT
           1450        1460        1470        1480        1490        1500        1510        1520        1530        1540        1550        1560

CGTTGGCAAGCTCGGAATTC
GCAACCGTTCGAGCCTTAAG
           1570        1580

FIG. 54 (Continued)
```

FIG. 55 - Exemplary Expression Construct for ctUBP6_96C

```
AAGCTTCGGTCACGCTTGGGACTGCCATAGGCTGCGGCCCGGTGATGCCGGCCACGATGCGTCCGGCGTAGAGGATCGAGATTCGATCCCGGAGAATTAATACGACTCACTATAGGGAGAC
TTCGAAGCCAGTGCGAACCCTGACGGTATCCGACGCCGGGCCACTACGGCACGGCCCGGTGCTACGCAGGCCGCCATTCCTAGAGCTCTAGCTCTAAGCTAGGGCGCTTTAATTATGCTGAGTGATATCCCTCTG
         10        20        30        40        50        60        70        80        90       100       110       120

M  V  E  E  P  V  D  N  K  P  G  T  D  T  S  A  E  D  T  I  K  V
CACAAACGGTTCCCTCTAGAAATAATTTGTTTAACTTAAGAAGAGAATATACCATGGTTGAAGAACCAGTAGATAATAACCAGTGCAATTGAAGAAATTAACCAAGCAGTGGCTCTTAGGTAAAAAATGA
GTGTTGCCAAAGGGAGATCTTTATTAAACAAATTGAATTCTTCCTCTATATGGTACCAACTTCTTGGTCATCTATTATTGGTCATCGAGAATCCAACTTCGTCCACCCAGAATCATTTTTTAGCT
         130       140       150       160       170       180       190       200       210       220       230       240

G  I  L  H  S  L  S  G  T  M  A  I  S  E  V  S  L  K  D  A  E  L  M  A  I  E  E  I  N  Q  A  G  G  L  L  G  K  K  I  E
CGGCATTTTACATTCACTCTGCACTATGGCAATCTCCGAGGTCTCCCTCAAAGATGCCGAACTCATGGCAATTGAAGAAATTAACCAAGCAGGTGGCTCTTAGGTAAAAAATCGA
GCCGTAAAATGTAAGTGAGACGTGATACCGTTAGAGGCTCCAGAGGAGTTCTACGGCTTGAGTACATTGGTTCGTCCACCCGAGAATCATTTTTTAGCT
         250       260       270       280       290       300       310       320       330       340       350       360

P  V  I  E  D  G  A  S  D  W  P  T  F  A  E  K  A  K  K  L  L  Q  N  D  K  V  A  T  V  F  G  C  W  C  S  A  S  R  K  A
ACCAGTAATTGAAGACGGGGCCTCCGACTGGCCTACATTCGCTGAAAAGGCAAAGAAGTTACTTCAAAACGACAAAGTTGCAACCGTCTTCGGCTGTGTTCCGCATCCGCGTAAAGC
TGGTCATTAACTTCTGCCCCGGAGGCTGACCGGATGTAAGCGACTTTTCCGTTTCTTCCAATGAAGTTTTGCTGTTTCAACGTTGGCAGAAGCCGACAACCAAGGCGTAGCGCATTTCG
         370       380       390       400       410       420       430       440       450       460       470       480

V  L  P  V  F  E  E  N  N  G  L  L  W  Y  P  V  Q  Y  E  G  M  E  S  S  P  N  I  F  Y  T  G  A  A  P  N  Q  Q  I  V  P
TGTCTTGCCAGTCGTTCTTCGAGGAGAACAACGGGTTACTGTGGTATCCGGTACAATACGAGGGCATGGAATCAAGCCCAAACATTTTTTACACAGGGGGCCGCTCCGAATCAGCAGATTGTACC
ACAGAACGGTCAGAAGCGTCAGAAGCTCCTCTTGTTGCCCAATGACATAGGCCATGGCCCAATGACACCATAGGCCATGTATGCTCCCGAGGCTTAGTCGTCTAGTCGTCTAACATGG
         490       500       510       520       530       540       550       560       570       580       590       600

A  V  E  W  L  L  E  N  K  G  K  R  F  F  L  L  G  S  D  Y  V  F  P  R  T  A  N  K  I  I  K  A  Q  L  S  A  I  G  G  E
AGCAGTGGAATGGCTCTTAGAAATAAGGCAAAACGGTTCTTCTTCTTCCCTTGGCTCCGAGATTACGTATTCCCACGCACGGCAAATAAGATTATTAAGGCGCAGCTGTCCGAATCGGGGGGA
TCGTCACCTTACCGAGAATCTTTATTCCGTTTGCCAAGAACAGGAACGAGCCGTAAGAATGGTGCCGTGCCGTCGACAGGCGTTAGCGCCCCCT
         610       620       630       640       650       660       670       680       690       700       710       720

L  I  A  E  E  Y  T  P  L  G  H  T  D  Y  S  T  I  V  N  K  I  K  T  A  K  P  D  V  F  N  T  L  N  G  D  S  N  V  A
GCTTATTGCCGAGGAATACACTCCATTGGGTCACACCGACTATAGTACCATTGTCAACAAAATCAAGACGGCGAAGCCGGATGTAGTATTCAACACATTGAACGGGACTCCAACGTTGC
CGAATAACGGCTCCTTATGTGAGGTAACCCAGTGTGGCTGATAATCATGGTAACATCATCATCATAGTATATGTCAACAAGTTGTGTAACTTGCCCCTGAGGTTGCAACG
         730       740       750       760       770       780       790       800       810       820       830       840

F  F  K  Q  L  K  D  A  G  I  T  S  E  D  I  T  V  C  S  V  S  V  A  E  E  I  R  G  I  G  A  E  N  I  K  G  H  L  V
CTTCTTTAAACAGCTCAAAGACGCGGGGGATCACCTCCGAAGACATTACCGTATGTTCAGTCAGCGCTCGCCAGGAAGAAATTCGTGGCATCGGGGCGAAAATATTAAGGGGCCACTCGT
GAAGAAATTTGTCGAGTTTCTGCGCCCCTAGTGAGGGCTTCTGTAATGGCATACAAGTCAGTCGCGAGCGGTCGGCCGGCGTTCTTCTTTAAGCACCGTAGCATCCCGTAGCATTAATTTCCCGTGAGCA
         850       860       870       880       890       900       910       920       930       940       950       960
```

```
                           270                         280                         290                         300
   S   W   N   Y   Y   Q   T   T   D   D   T   P   E   N   K   E   F   V   E   K   Y   K   S   K   Y   G   S   D   R   V   T   D   D   P   I   E   A   A   Y   I   A
TAGTTGGAACTACTACCAAACCACCGACACCCCCGGAAAATAAGGAGTTCGTCGAGAAGTATAAATCGAAGAAGTATAAATGGGAGCGCGTCACCGATGATCAATTGAGGCAGCCTACATCGC
ATCAACCTTGATGATGGTTGGTGGCTGTGGGGCCCTTTTATTCCTCAAGCAGCTCTTCAAGCAGCTCTTCATATTTAGCTTTATACCCTCGCTGCGCAGTGGCTACTAGGTTAACTCCGTCGGATGTAGCG
     970         980         990        1000        1010        1020        1030        1040        1050        1060        1070        1080

310                         320                         330                         340
   V   H   L   W   A   E   A   V   K   K   A   G   S   F   E   V   K   V   K   E   A   A   K   G   L   E   F   K   A   P   E   G   L   V   K   I   E   G   E
CGTACACTTATGGGCAGAAGCAGTCAAGAAGCAGGTCGTTGAAGTAGAGAAGTGAAAGAGCCGCCAAGGCTTAGAGTTTAAAGCCTGAAGGGTTAGTAAGATCGAGGGGGA
GCATGTGAATACCCGTCGTCAGTTCTTCGTCGACAAGCTTCAGTCTCTTCCGGCGGTTCCCAGCAAATCTCAAATTTCGCGGACTTCCAATCATTTCTAGCTCCCCCT
    1090        1100        1110        1120        1130        1140        1150        1160        1170        1180        1190        1200

350                         360                         370                         380
   N   Q   H   L   W   K   P   V   R   I   G   E   V   Q   E   D   G   L   I   K   E   I   W   S   T   S   E   A   V   R   P   D   P   Y   L   K   T   Y   D   W
GAATCAGCATCTCTGAAGCCAGTCCGTATTGGTGAAGTACAGGAGGACGGTTTAATCAAGGAGATCTGGTCGACCAGCGAAGCAGTCCGTCGACCCTTACTTGAAAACTTACGATTG
CTTAGTCGTAGAGACTTCGGTCAGGACTTCCATGTCCTCCTGCCAAATTAGTTCCTCTAGACCAGCTGGTCGCTTCGTCAGGCAGCCTGGAATGACTTTGAATGCTAAC
    1210        1220        1230        1240        1250        1260        1270        1280        1290        1300        1310        1320

390
   A   K   G   L   S   D   G   G   S   H   H   H   H   H   H   *
GGCCAAAGGCCTCAGCGATGGGGTAGTCATCATCATCATCATCATTAATGAAAGGCCGATATCCAGCACACTGGCGCCCGTTACTAGTCGGATCCGGCTGCTAACAAAGCCCGAAAGAA
CCGGGTTTCCGGAGTCGCTACCCCATCAGTAGTAGTAGTAGTAGTAATTACTTTCCCGCTATAGGTCGTGTGACCGCGGCAATGATCATCAGCCTAGGCCGACGATTGTTTCGGGCTTTCCTT
    1330        1340        1350        1360        1370        1380        1390        1400        1410        1420        1430        1440

GCTGAGTTGGCTGCTGCTGCCACCGCTGCACCGCTGAGCAATAACTAGCAATAACCCCTTTGGGCCCTCTAAACGGTCTTGAGGGGTTTTTTGCTGAAAGGAGGAACTATATCCGGAGGACTCCCACGGCA
CGACTCAACCGACGACGGTGCCGACTCGTTATTGATCGTATTGGGGAACCCCGGAGATTTGCCCAGAACTCCCAAAAAAACGACTTTCCTCCTTGATATAGGCCTCGCTCGAGGGTGCCGT
    1450        1460        1470        1480        1490        1500        1510        1520        1530        1540        1550        1560

CGTTGGCAAGCTCGGAATTC
GCAACCGTTCGAGCCTTAAG
    1570        1580

FIG. 55 (Continued)
```

FIG. 56 - Exemplary Expression Construct for ctUBP6_97C

```
AAGCTTCGGTCACGCTTGGGACTGCCATAGGCTGCCCGGTGATGCCGGCCACGATGCGTCCGGCGTAGAGGATCGAGAATCTCGATCCCGGCGTAGAGGATTAATACGACTCACTATAGGGAGAC
TTCGAAGCCAGTGCGACCCTGACGGTATCCGACGGGCCACTACGGCCGGGCCCGGTGTACGCAGGCCGCATCCTAGCTCTAGAGCTAGGGCGCCATCTCCTAGCACTCTTAAGCTGAGTGATATCCCTCTG
         10        20        30        40        50        60        70        80        90        100       110       120

M   V   E   E   P   V   D   N   K   P   G   T   D   T   S   A   E   D   T   I   K   V
CACAAACGGTTCCCTCTAGAGAATAATTTGTTTAACTTTAAGAAGAGAGATATACCATGGTTGAAGAACAGTAGATAATAAACCAGTAGCACACTTCAGCAGGACCGACGATCAAGGT
GTGTTGCCAAGGGAGATCTTATTAAACAAATTGAAATTCTTCCTATATGGTACCAACTTCTTGGTCATCTATTATTTGGTCATCGTGAAGTCGTCTCCTGCTAGTTCCA
         130       140       150       160       170       180       190       200       210       220       230       240

G   I   L   H   S   L   S   G   T   M   A   I   S   E   V   S   L   K   D   A   E   L   M   A   I   E   E   I   N   Q   A   G   G   L   L   G   K   K   I   E
CGGCATTTTACATTCACTCTGTCTGGCACTATGGCTATCTCCGAGGTCTCCCTCAAAGATGCCGAACTCATGGCAATTGAAGAATAACCAGTAGCAGTGGCTCTTAGGTAAAAATCGA
GCCGTAAAATGTAAGTGACAGATGAGACCGTGATACCGATAGAGGCTCCAGAGGGAGTTCTACGGCTTGAGTCATGTACCGTTAACTTCTTAATTGGTCGTCCACCGAGAATCATTTTTAGCT
         250       260       270       280       290       300       310       320       330       340       350       360

P   V   I   E   D   G   A   S   D   W   P   T   F   A   E   K   K   L   L   Q   N   D   K   V   A   T   V   F   G   C   W   T   C   A   S   R   K   A
ACCAGTAATTGAAGACGGGCCCTCCGACTGGCCTACATTCGCTGAAAAGCAAAGAAGTACTTCAAATGACAAAAGTTGCAACCGTCTTCGCTGTTGACATGTGCATCGCGTAAAGC
TGGTCATTAACTTCTGCCCGGGAGGCTGACCGGATGTAAGCGACTTTCGTTTCTTGAAGTTTGCTGTTTCAATGAAGTTTTGCAGAAGCGACAACTGTACACGTAGCGCATTTCG
         370       380       390       400       410       420       430       440       450       460       470       480

V   L   P   V   F   E   E   N   N   G   L   L   W   Y   P   V   Q   Y   E   G   M   E   S   S   P   N   I   F   Y   T   G   A   A   P   N   Q   Q   I   V   P
TGTCTTGCCAGTCTTCGAGGAGAACAACGGGTTACTGTGGTATCCGGTACAATACGAGGGCATGGAATCAAGCCCAAACATTTTTACACAGGGGCCGCCGCCCGAATCAGCAGATTGTACC
ACAGAACGGTCAGAAGCGTCAGAAGCTCCTCTTGTTGCCCAATGACATACCATAGGCCATGATTATGCTCCCGGTACGTTATGCTCCCGGCTTAGTCGTCGTCTAACATGG
         490       500       510       520       530       540       550       560       570       580       590       600

A   V   E   W   L   L   E   N   K   G   K   R   F   F   L   L   G   S   D   Y   V   F   P   R   T   A   N   K   I   I   K   A   Q   L   S   A   I   G   G   E
AGCAGTGGAATGGCTCTTAGAAAATAAAGGCAAAACGTTCTTCTTTCTCCTTGGCTCGGATTACGATTCCCACGCACGGCAAATAAGATTATTAAGGCGAGCTGTCCGAATCGGGGGGA
TCGTCACCTTACCGAGAATCTTTTATTTTCCGTTTTGCCGTTTGCAAGAAGAGAGAACCGAGCCTAATGCTAATGCTAAGGCGGTGCCGCCGTTTATTCTAATAATTCCGCGTCGACAGGCGTTAGCCCCCCT
         610       620       630       640       650       660       670       680       690       700       710       720

L   I   A   E   E   Y   T   P   L   G   H   T   D   Y   S   T   I   V   N   K   I   K   T   A   K   P   D   V   V   F   N   T   L   N   G   D   S   N   V   A
GCTTATTGCCGAGGAATACACTCCATTGGGTCACACCGACTATAGTACCATTGTCAACAAATCAAGACGGAAGCCGATGTAGTATTCAACACATTGAACGGGGACTCCAACGTTGC
CGAATAACGGCTCCTTATGTGAGGTAACATGAGTGGCTGATAATCATGGTAACATGGTAACATTGTTTAGTTCTGTTCTGATCATAAGTTGTGTAACTTGCCCCTGAGGTTGCAACG
         730       740       750       760       770       780       790       800       810       820       830       840

F   F   K   Q   L   K   D   A   G   I   T   S   E   D   I   T   V   C   S   V   S   V   A   E   E   I   R   G   I   G   A   E   N   I   K   G   H   L   V
CTTCTTTAAACAGCTCAAAGACGCGGGGATCACCTCCGAAGACATTACCGTATGTTCAGTCAGTGTTGCTGAAGAAATTCGTGGCATCGGGCCGAAAAATATTAAGGGCCACTCGT
GAAGAAATTTGTCGAGTTTCTGCAGTTTCTGCGCCCTAGTGGAGGCTTCTGTAATGGCATACAAGTCAGTCACAACGAGCTTCTTTAAGCAACCGTAGCGCCGGCGTTCTAATTCCCGTGAGCA
         850       860       870       880       890       900       910       920       930       940       950       960
```

```
              270             280             290             300
S W N Y Y Q T T D D T P E N K E F V E K Y K S K Y G S D R V T D D P I E A A Y I A
TAGTTGGAACTACTACCAAACCACGACACCCCGGAGAATAAGGAGTTCGTCGAGAAGTATAAATCGAAGTATGGAGCGCGTCACCGATGATCCAATTGAGGCAGCCTACATCGC
ATCAACCTTGATGATGGTTGGTGGCTGTGGGGCCTTTATTCCTCAAGCAGCTCTTCATATTTAGCTTTATACCCTCGCTGGCTACTAGGTTAACTCCGTCGATGTAGCG
    970         980         990        1000        1010        1020        1030        1040        1050        1060        1070        1080

310             320             330             340
V H L W A E A V K K A G S F E V K K A G L E F K A P E G L V K I E G E
CGTACACTTATGGGCAGAAGCAGTCAAGAAGCAAGAAGCAGGGCCTTGAAGTAGAGAAAGTGAAAGAGGCCCAAGAGCCTTAGAGTTTAAAGCCCTGAAGGGTTAGTAAAGATCGAGGGGA
GCATGTGAATACCCGTCTTCGTCAGTTCTTCGTCGTCCCAGCAAACTTCATCTCTTCGACTTCTCCGGGGTTCCCGAATCTCAAATTTCGGGACTTCCCAATCATTTCTAGCTCCCCCT
    1090        1100        1110        1120        1130        1140        1150        1160        1170        1180        1190        1200

350             360             370             380
N Q H L W K P V R I G E V Q E D G L I K E I W S T S E A V R P D P Y L K T Y D W
GAATCAGCATCTCTGAAGCCAGTCCGTATTGGTGAAGTACAGGAGGACGGTTTAATCAAGGAGATCTGGTCGACCAGCGAAGCAGTCCGTCCGGACCCTTACTTGAAAACTTACGATTG
CTTAGTCGTAGAGACTTCCGGTCAGGACCAATAACCACTTCCATGTCCTCTAGACATTAGTTCCTCTAGACCAGCTGGTCGCTTCGTCAGGCAGCCCTGGAATGACATCTTTGAATGCTAAC
    1210        1220        1230        1240        1250        1260        1270        1280        1290        1300        1310        1320

390
A K G L S D G G S H H H H H H * *
GGCCAAAGGCCTCAGCGATGGGGTAGTCATCATCATCATCATTAATGAAAGGCCGATATCAGCACACTGGCGCCCGTTACTAGTCGGATCCGGCTGCTCTAACAAAGCCCGAAAGAA
CCGGTTTCCGGAGTCGCTACCCCATCAGTAGTAGTAGTAGTAATTACTTTCCGCTATAGTCGTGTGACCGCCGCAATGATCATCCAGGTAGTTCGCGGACGATTGTTCGGGCTTTCTT
    1330        1340        1350        1360        1370        1380        1390        1400        1410        1420        1430        1440

GCTGAGTTGGCTGCTGCTGCCACCGCTGCCTCGAGCAATAAACCCGCTGGAGCAATAACTAGCATAACCCCTTGGGCCTCTAAACGGTCTTGAGGGGTTTTTTGCTGAAAGGAGAACTATATCCGAGGACTCCCACGGCA
CGACTCAACGACGACGACGTGCGACTCGTTATTGATGATCGTATTGGGGAACCCCGGAGATTTGCCCAGAACTCCCAAAAAACGACTTTCCTCCTTGATATAGGCCTCGCCTGAGGGTGCCGT
    1450        1460        1470        1480        1490        1500        1510        1520        1530        1540        1550        1560

CGTTGGCAAGCTCGGAATTC
GCAACCGTTCGAGCCTTAAG
    1570        1580

FIG. 56 (Continued)
```

FIG. 57 - Exemplary Expression Construct for ctUBP6_98C

```
                  270                    280                     290                         300
        S  W  N  Y  Y  Q  T  T  D  T  P  E  N  K  E  F  V  E  K  Y  K  S  K  Y  G  S  D  R  V  T  D  D  P  I  E  A  A  Y  I  A
        TAGTTGGAACTACTACCAAACCACCGACACCCCCGGAAAATAAGGAGTTCGTCGAGAAGTATAAATCGAAGTATATAAATGGGAGCGCGTCACCGATGATGATCCAATTGAGGCAGCCTACATCGC
        ATCAACCTTGATGATGGTTTGGTGGCTGTGGGGGCTGTGGGGCCTTTTATTCCTCAAGCAGCTCTTCAAGCAGCTCTTCATATTTAGCTTTATACCCTCGCTGCGCAGTGGCTACTAGGTTAACTCCGTCGGATGTAGCG
        970        980        990        1000       1010       1020       1030       1040       1050       1060       1070       1080

310                     320                         330                         340
        V  H  L  W  A  E  A  V  K  K  A  G  S  F  E  V  K  V  K  E  A  A  K  G  L  E  F  K  A  P  E  G  L  V  K  I  E  G  E
        CGTACACTTATGGGCAGAAGCAGTCAAGAAGGCTCAAGAAGCAGGTCGTCGTTTGAAGTAGAGAAAGTGAAAGACCCGCCAAGGCTTAGAGTTTAAAGCCTGGCCAGTGGCCAGTAGTAAAGATCGAGGGGGA
        GCATGTGAATACCCGTCTCGTCAGTTCTTCAGTCCCAGCAAACTTCATCTCTTCGCGCGGTTCCCGAATCTCAAATTTCGCGGACTTCCAATCATTTCTAGCTCCCCCT
        1090       1100       1110       1120       1130       1140       1150       1160       1170       1180       1190       1200

350                     360                         370                         380
        N  Q  H  L  W  K  P  V  R  I  G  E  V  Q  E  D  G  L  I  K  E  I  W  S  T  S  E  A  V  R  P  D  P  Y  L  K  T  Y  D  W
        GAATCAGCATCTCTGAAGCCAGTCCGTATTGGTGAAGTACAGGACGACGGTTTAATCAAGGAGATCTGGTCGACCAGCGAAGCAGTCCGTCCGGACCCTTACTTGAAAACTTACGATTG
        CTTAGTCGTAGAGACTTCCGGTCAGGACTTCATGTCCTCTAGACCAGCTGGTCGCTTCGTCAGGCAGCCCTGGAATGAACTTTTGAATGCTAAC
        1210       1220       1230       1240       1250       1260       1270       1280       1290       1300       1310       1320

390
        A  K  G  L  S  D  G  G  S  H  H  H  H  H  H  *
        GGCCAAAGGCTCAGCGATGGGGGTAGTCATCATCATCATCATTAATGAAAAGGCCGATATCCAGCACACTGGCGCCCGTTACTAGTCGGATCCGGCTCCTAACAAAGCCCGAAAGAA
        CCGGGTTTCCGGAGTCGCTACCCCATCGATCAGATAGTAGTAATTACTTTCCCGCTATAGTCGTGTGACCGCCAATGATCAGCCAGGCGGAATTGTTCGGGCTTTCTT
        1330       1340       1350       1360       1370       1380       1390       1400       1410       1420       1430       1440

GCTGAGTTGGCTGCTGCTGCCACCGCTGCCACCCGCTGAGCAATAACCCTGGCCTTCTAAACGGTCTTGAGGGTTTTTGCTGAAAGGAGAACTATATCCGGAGGACTCCCACGGCA
        CGACTCAACCGACGACGGCTGCTATTGGATTTGCCCCAGAACCCCGGAGATTTGCCCAGAACTCCCAAAAAACGACTTCCCTTGATAATGCCCTGCGCTGAGGGTGCCCGT
        1450       1460       1470       1480       1490       1500       1510       1520       1530       1540       1550       1560

CGTTGGCAAGCTCGGAATTC
        GCAACCGTTCGAGCCTTAAG
        1570       1580

FIG. 57 (Continued)
```

FIG. 58 - Exemplary Expression Construct for ctUBP6_164C

```
                   270              280              290              300
  S  W  N  Y  Y  Q  T  T  D  T  P  E  N  K  E  F  V  E  K  Y  K  S  K  Y  G  S  D  R  V  T  D  D  P  I  E  A  A  Y  I  A
TAGTTGGAACTACTACCAAACCACCGACACCCCGGAAAATAAGGAGTTCGTCGAGAAGTATAAATCGAAATATGGGAGCGCGTCACCGATGATCCAATTGAGGCAGCCTACATCGC
ATCAACCTTGATGATGGTTTGGTGGCTGTGGGGGCCTTTTATTCCTCAAGCAGCTCTTCATATTTAGCTTTATACCCTCGCGCAGTGGCTACTAGGTTAACTCCGTCGATGTAGCG
     970        980        990       1000       1010       1020       1030       1040       1050       1060       1070       1080
                   310              320              330              340
  V  H  L  W  A  E  A  V  K  K  A  G  S  F  E  V  K  V  K  E  A  A  K  G  L  E  F  K  A  P  E  G  L  V  K  I  E  G  E
CGTACACTTATGGGCAGAAGCAGTCAAGAAGCAAGGTCGTTTGAAGTAGAGAGAAGTGAAAGAGGCCCAAGGCCTTAGAGTTTAAAGCGCCTGAAGGGTTAGTAGGATCGAGGGGGA
GCATGTGAATACCCGTCTCGTCAGTTCGTTCGTCCAGCAAACTTCATCTCTTCACTTTCTACTTTCTCCGGACTTCCCAATCATTTCTAGCTCCCCCT
    1090       1100       1110       1120       1130       1140       1150       1160       1170       1180       1190       1200
                   350              360              370              380
  N  Q  H  L  W  K  P  V  R  I  G  E  V  Q  E  D  G  L  I  K  E  I  W  S  T  S  E  A  V  R  P  D  P  Y  L  K  T  Y  D  W
GAATCAGCATCTCTGAAGCCAGTCCGTATTGGTGAAGTACAGGAGGACGGTTTAATCAAGGAGATCTGGTCGACCAGCGAAGCAGTCCGTCGGACCCTTACTTGAAAACTTACGATTG
CTTAGTCGTAGAGACTTCGGTCAGGAATAACCATTCATGTCCTCCTGCCAAATTAGTTCCTCTAGACCAGCTGGTCGCTTCGTCAGGCAGCCTGGAATGACTTTGAATGCTAAC
    1210       1220       1230       1240       1250       1260       1270       1280       1290       1300       1310       1320
                   390
  A  K  G  L  S  D  G  G  S  H  H  H  H  H  H  *  *
GGCCAAAGGCCTCAGCAGTCGGGGTAGTCATCATCATCATCATTAATGAAAGGCCGATATCAGCACACTGGCGCCCGTTACTAGTGGATCCGGCTGCTAACAAAGCCCGAAAGAA
CCGGTTTCCGGAGTCGTCAGCCCATCAGTAGTAGTAGTAGTAATTACTTTCCGCTATAGTCGTGTGACCGCCAATGATCAGCCAGCCTTCGGCCTTCCTT
    1330       1340       1350       1360       1370       1380       1390       1400       1410       1420       1430       1440
GCTGAGTTGGCTGCTGCTGCCACCGCTGAGCAATGAAAAACTAGCAATAACCCCTTGGGCCTCTAAACGGTCTTGAGGGTTTTTTGCTGAAAGGAGAACTATATCCGAGGACTCCCACGGCA
CGACTCAACGACGACGGCGTGCGACTCGTTATTGATCGTATTGGGGAACCCCGGAGATTTGCCCAGAACTCCCAAAAAACGACTTTCCTCCTTGATATAGGCCTCGCTGAGGGTGCCGT
    1450       1460       1470       1480       1490       1500       1510       1520       1530       1540       1550       1560
CGTTGGCAAGCTCGGAATTC
GCAACCGTTCGAGCCTTAAG
    1570       1580

FIG. 58 (Continued)
```

FIG. 59 - Exemplary Expression Construct for ctUBP6_191C

```
     270              280              290              300
S W N Y Y Q T T D T P E N K E F V E K K Y K S K Y G S D R V T D D P I E A A Y I A
TAGTTGGAACTACTACCAAACCACGACACCCCGGAAAATAAGGAGTTCGTCGAGAAGTATAAATCGAAGTATGGAGCGCGTCACCGATGATCCAATTGAGGCAGCCTACATCGC
ATCAACCTTGATGATGGTTGGTGGCTGTGGGGCCTTTATTCCTCAAGCAGCTCTTCATATTTAGCTTTATACCCTCGCTGCGCAGTGGCTACTAGGTTAACTCCGTCGATGTAGCG
     970       980       990      1000      1010      1020      1030      1040      1050      1060      1070      1080

310              320              330              340
V H L W A E A V K K A G S F E V K V K E A A K G L E F K A P E G L V K I E G E
CGTACACTTATGGGCAGAAGCAGTCAAGAAGGCTCAAGGAGTCAAGGTAGAGAAGAAGTGAAAGAAGCCGCCAAGGGCTTAGAGTTTAAAGCCCTGAAGGGTTAGTAAGATCGAGGGGA
GCATGTGAATACCCGTCTTCGTCAGTTCTTCGTCGTTCCCAGCAAACTTCATCTCTTCACTTCTCCGGACTTCCCAATCATTTCGAAGCTTCAGTCCCCCT
    1090      1100      1110      1120      1130      1140      1150      1160      1170      1180      1190      1200

350              360              370              380
N Q H L W K P V R I G E V Q E D G L I K E I W S T S E A V R P D P Y L K T Y D W
GAATCAGCATCTCTGAAGCCAGTCCGTATTGGTGAAGTACAGGAGGACGGTTTAATCAAGGAGATCTGGTCGACCAGCAGCAGTCCGTCCGGACCCTTACTTGAAAACTTACGATTG
CTTAGTCGTAGAGACTTCGGTCAGGAGACTTCCTGCTGCCAAATTAGTTCCTCTAGACCAGCTGGTCGTCGTCAGGCAGCCTGGAATGACAGGCAGCCTTTGAATGCTAAC
    1210      1220      1230      1240      1250      1260      1270      1280      1290      1300      1310      1320

390
A K G L S D G S H H H H H H * *
GGCCAAAGGCCTCAGCGATGGGGTAGTCATCATCATCATCATTAATGAAAGGCCGATATCCAGCACACTGGCGCCCGTTACTAGTGGATCCGGCTGCTAACAAAGCCCGAAAGAA
CCGGTTTCCGGAGTCGCTACCCCATCAGTAGTAGTAGTAGTAATTACTTTCCCGCTATAGGTCGTGTGACCGCCAATGATCACCAGGCCGACGATTGTTTCGGCTTTCCTT
    1330      1340      1350      1360      1370      1380      1390      1400      1410      1420      1430      1440

GCTGAGTTGGCTGCTGCTGCCACCGCTGAGCAATGAGCAATAACTAGCATAACCCCTTGGGCCTTCTAAACGGTCTTGAGGGGTTTTTGCTGAAAGGAGGAACTATATCCGGAGGACTCCCACGGCA
CGACTCAACGACGACGGCGTGCCGACTCGTTATTGGCGACTCCCGGAGATTTGCCCAGAACTCCCAAAAAACGACTTTCCTTCCTTGATATAGGCCTCGCCTCGAGGGTGCCGT
    1450      1460      1470      1480      1490      1500      1510      1520      1530      1540      1550      1560

CGTTGGCAAGCTCGGAATTC
GCAACCGTTCGAGCCTTAAG
    1570      1580

FIG. 59 (Continued)
```

FIG. 60 - Exemplary Expression Construct for csUBP7_186C.1

```
CGCTTGGGACTGCCATAGCTGGCCCGGTGATGCCGCCACGATGGCTCCGGCGTAGAGATGATCGAGATCTCGATCCCGCGTAGAGGATTAATACAGACTCACTATAGGGAGACCACAACGGTTTC
GCGAACCCTGATCCGACGGGCCACTACGGCCGTGCTACGCAGGCCATCCTAGCTCCTAGAGAGCGCTTAATTATGCTGAGTGATATCCCTCGTGTTGCCAAAG
         10        20        30        40        50        60        70        80        90       100       110       120
                                                                M  S  S  E  K  K  S  E  E  T  I  K  V  G  I  L  H  S  L  G  T
CCTCTAGAAATAATTTGTTAACTTTAAGAAGGAGATATACCATGAGTTCATCAGAATCAGAAAAGTGAAGAGACCATCAAAGTAGGGATTCTCCACAGCTTGAGTGGTAC
GGAGATCTTTATTAAACAATTGAAATTCTTCCTCTATATGGTACTCAAGTAGTCTTAGTCTTTTCTTTTTCATCCTAAGAGTGTCGAACTCACCATG
                           10                            20
        130       140       150       160       170       180       190       200       210       220       230       240
     M  S  I  S  E  V  S  L  K  D  A  E  L  M  A  I  Q  E  I  N  N  N  G  G  V  L  G  K  K  L  E  P  I  V  E  D  G  A  S  D
GATGTCAATCTCAGAAGTTCCTTAAAAGATGCCGAATTAATGGCCATCCAGGAGATCAACAATAATGGCGGTGTGTTAGGTAAAAAGTTAGAACCGATCGTGGAAGATGGCGCCTCAGA
CTACAGTTAGAGTCTTCAAGGAATTTTCTACGGCTTAATTACTACCGGCCACACAATCATTTTCAATCTTGGCTAGCACCTTCTACCGCGGAGTCT
        30                            40                            50                            60
        250       260       270       280       290       300       310       320       330       340       350       360
W  P  T  F  A  E  K  A  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAAACTTTTACAGAAGGACAAAGTTGGCAGTAATTTTCGGCGCTTGACCTGCCAAGTCGCAAAGCCGTACTCGTCGAAGAAATAA
GACCGGCTGAAGCGACTTTCCGATTCTTTGAAAATGTCTTCCTGTTCCAACCGTCATTAAAAAGCCGCGAACCTGAGCCGTTCAGCGTTTCGGCATGAGAGGTCAGCAGCTTCTTTTATT
                           70                            80                            90                           100
        370       380       390       400       410       420       430       440       450       460       470       480
G  L  L  F  Y  P  V  Q  Y  E  G  L  E  S  S  P  N  I  F  Y  M  G  A  A  P  N  Q  Q  I  V  P  A  V  K  W  L  F  D  N  G
TGGGCTTCTCTTCTATCCGGTTCAGTATGAAGGTCTCGAAAGTTCCCAAATATCTTTTACATGGGCGCCGCCCCAAACCAGCAGATCGTGCCAGCAGTTAAATGGCTCTTCGACAACGG
ACCCGAAGAAGATAGGCCAAGTCATACTTCCAGAGCTTTCAAGGGGTTTATAGAAAATGTACCCGCGGCGGGGTTTGGTCGTCTAGCACGGTCGTCAATTTACCGAGAAGCTGTTGCC
       110                           120                           130                           140
        490       500       510       520       530       540       550       560       570       580       590       600
K  K  R  F  Y  L  L  G  S  D  Y  Y  V  F  P  P  R  T  A  N  K  I  H  K  A  Y  L  K  Y  L  G  G  V  V  V  G  E  E  Y  T  P  C
AAGAAGCGTTTCTACCTCTTGGGCTCCGATTATGTATTCCCACGCACAGCAAACAAGATTATTAAGGCATACCTCAAATACCTCGGCGGTGTTGTAGTAGGTGAAGAATACACCCCATG
ATTCTTCGCAAAGATGGAGAACCCGAGCCTAATACATAAGGGTGCGTGTCGTTTGTATAATAATTCCGTATGGAGTTTATGGAGCCGCCACAACATCATCCACTTCTTATGTGGGGTAC
       150                           160                           170                           180
        610       620       630       640       650       660       670       680       690       700       710       720
G  H  T  D  Y  S  S  V  I  N  K  I  H  K  A  A  K  P  D  V  V  F  N  T  L  N  G  D  S  N  V  A  F  F  K  Q  L  K  D  A  G
TGGTCACACTGACTATAGTTCTGTCATTAATAAAATCAAAGCCGCAGAGCGTCGTATTTAACACTCTGAACGGGGATAGTAGCCTTTTTCAAGCAATTAAAGGATGCCGG
ACCAGTGTGACTGATATCAAGACAGTAATTATTTTAGTTTCGGCGTCTCGCAGCATAAATCATTACATCGGAAAAAGTTCGTTAATTCCTACGGCC
       190                           200                           210                           220
        730       740       750       760       770       780       790       800       810       820       830       840
I  D  A  N  T  L  P  V  M  S  V  S  I  A  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGATCAAAGGCATTGGTCCAGAGTATTTAAAAGGTCATCTGGTCACATGGAACTATTTCCAAAGTGTAGA
CTAACTGCGTTTATGTGAGGGACAGTACTCCGCACTCGTAGCCGGCCACGTCTCATAAATTTCCAGTAGACCAGTGTACCTTGATAAAGGTTTCACATCT
       230                           240                           250                           260
        850       860       870       880       890       900       910       920       930       940       950       960
```

```
            270                        280                        290                        300
T  P  E  N  K  E  F  V  E  N  Y  K  K  M  Y  G  E  D  R  V  T  D  D  P  I  E  A  A  Y  I  G  V  Y  L  W  A  K  A  V  E
TACACCGGAAACAAGGAGTTCGTTGAGAACTATAAGAAAATGTATGGGGAGGACCGGGTTGACAGATGACCCAATCGAGGCGGCATACATCGGCGTATACTTATGGGCTAAAGCGGTTGA
ATGTGGCCTTTGTTCCTCAAGCAACTCTTTGATATTCTTTTACATAGTCTACTGGGTTAGCTCCGCCGTATGTAGCCGCATATGAATACCCGATTTCGCCAACT
       970        980        990       1000       1010       1020       1030       1040       1050       1060       1070       1080

310                        320                        330                        340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCAGAGGGCCCAGTAAAGATTGACGGCGACAACCAGCACCCTCTACAAGACGGTGCG
CTTCCGCCCAGCTGTCTGCACACTATTCCAGGCCCTCCGGCGCTTCCCGTAGCTTAAATTGCGGGGTCTCATTTCTAACTGCCGCTGTTGGTCGTGGAGATGTTCTGCCACGC
      1090       1100       1110       1120       1130       1140       1150       1160       1170       1180       1190       1200

350                        360                        370                        380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTCGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTTAAGCACTCAACACCTTTGTTAATTTGTCTAGGTATAAATTTTCCAATACTTACCCGTGTCCCCAATTCGCTCGTTCCACC
      1210       1220       1230       1240       1250       1260       1270       1280       1290       1300       1310       1320

390
S  H  H  H  H  H  *  *
TTCACATCATCATCATCATTAATGAAAGGGCGATATCCAGCACTGGCGTCGCCGCTTACTAGTGGATCCGGCTGCTAACAAAGCCCGAAAGGAAGCTGAGTTGCTGCTGCCACCGCT
AAGTGTAGTAGTAGTAGTAATTACTTCCCGCTATAGGTCGTGTGACCGCCAATGATCACCTAGGCCGACGATTGTTTCGGGCTTTCCTTGACTCAACCGACGACGGTGCCGA
      1330       1340       1350       1360       1370       1380       1390       1400       1410       1420       1430       1440

GAGCAATAACTAGCATAACCCCTTGGGCCTCTAAACGGGTCTTTGAGGGGTTTTTTGCTGAAAGGAGGAACTATATCCGGAGGACTCCCACGGCACGTTG
CTCGTTATTGATCGTATTGGGGAACCCCGGAGATTTGCCCAGAAACGACTTTCCTCCTTGATATAGGCCTCGCTGAGGGTGCCGTGCAAC
      1450       1460       1470       1480       1490       1500       1510       1520       1530       1540

FIG. 60 (Continued)
```

FIG. 61 - Exemplary Expression Construct for csUBP7_186C.2

```
AAGCTTCGGTCACGCTTGGGACTGCCATAGGCTGCCGCCCGGTGATGCGTCCGGCGTAGAGAATCGAGAATCTGATCCCGGAGAAATTAATACGACTCACTATAGGGAGAC
TTCGAAGCCAGTGCGAACCCTGACGGTATCCGACCGGCGCCACTACGCACGGGCCGCCCGGTGCTACGCAGGCCCATCTCCTAGAGCTCTAGGGCGCTTTAATTATGCTGAGTGATATCCCTCTG
         10         20         30         40         50         60         70         80         90        100        110        120
                                                                                                 M  S  S  S  E  K  E  K  S  E  E  T  I  K  V  G  I  L  H  S
                                                                                                                                              20
CACAACGGTTTCCCTCTAGAAATATACCTTAAGAAGAGAGATATACCATGAGTTCATCAGAATCAGAAGAAGAGAAAAGTGAAGAGACCATCAAAGTAGGGATTCTCCACAG
GTGTTGCCAAAGGGAGATCTTATTAAACAATTGAAATTCTTCTATATGGTACTCAAGTAGTCTTAGTCTTTTTCACTTCTCTGGTAGTTCATCCTAAGAGGTGTC
        130        140        150        160        170        180        190        200        210        220        230        240
L  S  G  T  M  S  I  S  E  V  S  L  K  D  A  E  L  M  A  I  E  E  I  N  N  N  G  G  V  L  G  K  K  L  E  P  I  V  E  D
               30                                40                                50                                60
CTTGAGTGGTACGATGTCAATCTCAGAAGTTTCCTTAAAAGATGCGAATTAATGCGGATCAACAATAATGCGGTGTGTTAGGTAAAAGTTAGAACCGATCGTGAAGA
GAACTCACCATGCTACAGTTAGAGTCTTCAAAGGAATTTCTACGCTTAATTACGCCTAGTCGTTATTACGCCACAATCCATTTTCAATCTTGGCTAGCACCTTCT
        250        260        270        280        290        300        310        320        330        340        350        360
G  A  S  D  W  P  T  F  A  E  K  A  K  K  L  L  Q  K  D  K  V  A  V  I  F  G  A  W  T  S  A  S  R  K  A  V  L  P  V  V
               70                                80                                90                               100
TGGCGCCCTCAGACTGGCCGACCTTCGCTGAAAAGGCTAAGAAACTTTACAGAAGGACTAAGTTTCGGCGCTTGGACCTCGCAAGTCCCAAAGCCGTACTCCCAGTCGT
ACCGCGGAGTCTGACCGGCTGGAAGCGACTTTTCCGATTCTTTGAAAAGCGACTTTTCCGATTCAAGAACTGGAGCCGTTCAGCGTTCGGCAGTCGAGGTGTCAGCA
        370        380        390        400        410        420        430        440        450        460        470        480
E  E  N  N  G  L  L  F  Y  P  V  Q  Y  E  G  L  E  S  S  P  N  I  F  Y  M  G  A  A  P  N  Q  Q  I  V  P  A  V  K  W  L
              110                               120                               130                               140
CGAAGAAAATAATGGGCTTCTCTTCTATCCGGTTCAGTATGAAGGTCTCGAATGAAGTTCCCAAATATCTTTTACATGGGCGCCGCCCAAACCAGCAGATCGTGCCAGCAGTTAAATGCT
GCTTCTTTTTATTACCCGAAGAGAGAATAGGCCAAGTCATACTTCCAGAGCTTGTCAAGGGGTTTATAGAAAATGTACCCGCGGCGGGTTTGTCGTCTAGCACGGTCGTCAATTACCGA
        490        500        510        520        530        540        550        560        570        580        590        600
F  D  N  G  K  K  R  F  Y  L  L  G  S  D  Y  V  F  P  R  T  A  N  K  I  I  K  A  Y  L  K  Y  L  G  G  V  V  V  G  E  E
              150                               160                               170                               180
CTTCGACAACGGTTAAGAAGCGTTTCTACCTCTTGGGCTCGGATTATGTATTCCCACGCACAGCAAAGCCGCAAAGCCAGACGTCGTATTAAGGCATAACCTCAAATACCTCGGCCGGTGTTGTAGTAGGTGAAGA
GAAGCTGTTGCCATTCTTCGCAAAGATGAAGACATATAAAGGCCTAATACATAAGGGTGCGTGTCGTTTGTTCTAATAATTCCGTATGGAGTTATGCGACACGGTTATGACGGTTATGAGCCGCCACAACATCATCCACTTCT
        610        620        630        640        650        660        670        680        690        700        710        720
Y  T  P  C  G  H  T  D  Y  S  S  V  I  N  K  I  K  A  A  K  P  D  V  V  F  N  T  L  N  G  D  S  N  V  A  F  F  K  Q  L
              190                               200                               210                               220
ATACACCCCATGTGGTCACACTAGTTCTGTCATTAATAGTTCGATAGGCCGAAAGCCAGACGTCGTATTTAACACTCTGAACGGGATAGTAATGTAGCCTTTTCAAGCAATT
TATGTGGGGTACACCAGTGTGACTGATATGCAACTGTGACGAATCAAGAGACAGTAATTATTTAGTTGTCAGACTTGTGAGACTTGCCCCTATCATTACATCGGAAAAAGTTCGTTAA
        730        740        750        760        770        780        790        800        810        820        830        840
K  D  A  G  I  D  A  N  T  L  P  V  M  S  V  S  I  A  E  E  I  K  G  I  G  P  E  Y  L  K  G  H  L  V  T  W  N  Y  F
              230                               240                               250                               260
AAAGGATGCCGGGATTGACGCAAATACACTCCCTGCTCATGAGCGTGAGCATCGCCGAGGAGGAGATCGCCGAGGAGGAGATCGCCGAGTATTTAAAAGGTCATCTGGTCACATGGAACTATTT
TTTCCTACGCCCTAACTGCGTTTATGTGAGGGAGACAGTACTCGCACTCGTAAGCATCCTCCTCAGTTTCCGTAACCGATCTCATAAATTTTCCAGTAGACCAGTGTACCTTGATAAA
        850        860        870        880        890        900        910        920        930        940        950        960
```

```
        Q  S  V  D  T  P  E  N  K  E  F  V  E  K  Y  K  K  K  Y  G  E  D  R  V  T  S  D  P  I  E  A  A  Y  I  G  V  Y  L  W  A
     CCAAAGTGTAGATACACCGGAAAACAAGGAGTTCGTTGAGAAATATAAGAAAAAGTATGGGGAGGACCGGGTGACAAGCCGGTGACCACTACTGAGGCGGCATACATCGGCGGCGTATACTTATGGGC
     GGTTTCACATGTATGGTGGCTTTTTGTTCCTCAAGCAACTCTTTATATTCTTTTTCATAAGCTCCGGCCACCACTGTTGCTTGCGTGCCGCCGTTAGCTCCGGTTAGCTCCGCATGTAGCCGCATAGAATACCCG
            970           980           990          1000          1010          1020          1030          1040          1050          1060          1070          1080

310                                                320                                                330                                                340
        K  A  V  E  K  A  G  S  T  D  V  D  K  V  R  E  A  A  K  G  I  E  F  N  A  P  E  G  P  V  K  I  D  G  D  N  Q  H  L  Y
     TAAAGCGGTTGAGAAGGCGGGGTCGACAGACGTGGATAAGGTCCGGGAAGCGTGATCAGCCGCGAAGGGGCATCGAATTAACGCCCCAGAGGGCCAGTAAAGATTGACGGCGACAACCAGCACCTCTA
     ATTTCGCCAACTCTTCCGCTGAGGCTTCCAGGGCCGCTTCCGGTAGCTTAAATTGCGGGGTCTCCCGGGTCATTCTAACTGCCGTGTTGGTCGTGTGAGAT
           1090          1100          1110          1120          1130          1140          1150          1160          1170          1180          1190          1200

350                                                360                                                370                                                380
        K  T  V  R  I  G  E  I  L  E  N  G  Q  I  R  E  L  W  K  T  N  K  P  V  K  P  D  P  Y  L  K  G  Y  E  W  A  Q  G  L  S
     CAAGACGGTGCGTATTGGTGAGATCCTGGAGAACGGTCAAATTCGTGAGTTGTGAAAACAAATCAGTTAAACAGAATTCATATTTAAAAGGTTATGAATGGGCACAGGGGTTAAG
     GTTCTGCCACGCATAACCACTCTAGGACCTCTTGCCAGTTTAAGCACTCAACACACTTTGTTATTTGGTCAATTGGTCTAGTATATAAATTTCCAATACTTACCCGTCTCCCAATTC
           1210          1220          1230          1240          1250          1260          1270          1280          1290          1300          1310          1320

390
        E  Q  G  S  H  H  H  H  H  H  *  *
     CGAGCAAGGTTCACATCATCATCATCATCATTAATGAAAGGGCGATATCCAGCACACTGGCCGCCGTTACTAGTAGTGATCCGGCTAACAAAGCCCGAAAGAAGCTGAGTTGCT
     GCTCGTTCCAACAAGTGTAGTAGTAGTAGTAGTAATTACTTTCCCGCTATAGGTCGTGTGACCGCCGCAATGATCACCTAGGCCGACGATTGTTTCGGCTTCCTTCGACTCAACCGA
           1330          1340          1350          1360          1370          1380          1390          1400          1410          1420          1430          1440

GCTGCCACCGCGTGAGCAATAACTAGCATAACCCCTTGGGCCTCTAAACGGGTCTTCTTGAGGGTTTTTTGCTGAAAGGAGGAACTATATCCGAGCGACTCCCACGCACGTTGGCAAGCT
     CGACGGTGGCAGACTCGTTATTGATCGTATTGGGAACCCCGAGAATTTGCCCAAAAAACGACTTTCCTCCTTGATATAGGCCTCGCTGAGGTGCCGTGCAACCGTTCGA
           1450          1460          1470          1480          1490          1500          1510          1520          1530          1540          1550          1560

CGGAATTC
     GCCTTAAG

FIG. 61 (Continued)
```

FIG. 62 – Exemplary Expression Construct for csUBP7_186C.3

```
        Q  S  V  D  T  P  E  N  K  E  F  V  E  K  Y  K  K  K  Y  G  E  D  R  V  T  D  D  P  I  E  A  A  Y  I  G  V  Y  L  W  A
       CCAAAGTGTAGATACACCCGAAAACAAGGAGTTCGTTGAGAAATATAAGAAAAAGTATGGGGAGGACCGGGTGACAGATGACCCAATCGAGGCGGCATACATCGGCGTATACTTATGGGC
       GGTTTCACATCTATGTGGCCTTTGTTCCTCAAGCAACTCTTTATATTCTTTTTCATACCCCTCCTGGTTGACTGCTACTGGCCTACTGGACTCCGCCGTATGTAGCCGCATATGAATACCCG
            970        980        990       1000       1010       1020       1030       1040       1050       1060       1070       1080

310                             320                             330                             340
        K  A  V  E  K  A  G  S  T  D  V  D  K  V  R  E  A  A  K  G  I  E  F  N  A  P  G  G  P  V  K  I  D  G  D  N  Q  H  L  Y
       TAAAGCGGTTGAGAAGGCGGGTCGACAGAGTGGATAAGGTCGAGGAGGCCGCGAAGGGCATCGAATTTAACGCCCCAGTAAAGATTGACGGCGACAACCAGCACCTCTA
       ATTTCGCCAACTCTTCCGCCAGCTGTCTGCACCTATTCCAGGCGCGTTCCGGCGCTTCCCGTAGCTTAAATTGCGGGGTCAGTCATTCTAACTGCCGCTGTTGGTCGTGGAGAT
           1090       1100       1110       1120       1130       1140       1150       1160       1170       1180       1190       1200

350                             360                             370                             380
        K  T  V  R  I  G  E  I  L  E  N  G  Q  I  R  E  L  W  K  T  N  K  P  V  K  P  D  P  Y  L  K  G  Y  E  W  A  Q  G  L  S
       CAAGACGGTGCGTATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAG
       GTTCTGCCACGCATAACCACTCTAGGACCTCTTGCCAGTTGTTTAAGCACTCAACACCTTTGTTTATTTGGTCAATTCGTATAGGTCTAGGTATAAATTTCCAATACTTACCCGTCCCAATTC
           1210       1220       1230       1240       1250       1260       1270       1280       1290       1300       1310       1320

390
        E  Q  G  G  S  H  H  H  H  H  H  *  *
       CGAGCAAGGTCGTTCACATCATCATCATCATCATTAATGAAAGGGCGATATCCAGCACACTGGCCGCCGTTACTAGTGGATCCGGCTGCTAACAAAGCCCGAAAGGAAGCTGAGTTGGCT
       GCTTCGTTCCACCAAGTGTAGTAGTAGTAGTAGTAGTAATTACTTTCCCGCTATAGGTCGTGTGACCGGCGGCAATGATCACCTAGGCCGACGATTGTTTCGGCGTTTCCTTCGACTCAACCGA
           1330       1340       1350       1360       1370       1380       1390       1400       1410       1420       1430       1440

GCTGCCACCGCTGAGCAATAACTAGCATAACCCCTTGGGCCTCTAAACGGGTCTTGAGGGGTTTTTGCTGAAAGGAGGAACTATATCCGAGCGACTCCCACGGCACGTTGGCAAGCT
       CGACGGTGGCGACTCGTTATTGATCGTATTGGGAACCCGGAGATTTGCCCAGAACTCCCCAAAAAACGACTTTCCTTCCTTGATAATAGGCTCGCGCTGAGGGTGCCGTGCAACCGTTCGA
           1450       1460       1470       1480       1490       1500       1510       1520       1530       1540       1550       1560

CGGAATTC
       GCCTTAAG

FIG. 62 (Continued)
```

FIG. 63 - Exemplary Expression Construct for csUBP7_186C.4

```
CGCTTGGGACTGCCATAGCTGGCCCGGTGATGCCGGCCACGATGCTCGGCGTAGAGGATCGAGATCCTCGATCCCGCGAAATTAATACGACTCACTATAGGGAGACCACAACGGTTTC
GCGAACCCTGACGGTATCCGACCGGGCCACTACGGCCGTGCTACGACCCGCATCCTCCTAGCTCTAGAGCTAGGGCGCTTTAATTATGCTGAGTGATATCCCTCTGGTGTTGCCAAAG
         10        20        30        40        50        60        70        80        90       100       110       120
                                                                           M  S  S  S  E  E  K  S  E  E  T  I  K  V  G  I  L  H  S  L  S  G  T
CCTCTAGAAATAATTTTGTTTAACTTTAAGAAGGAGATATACCATGAGTTCATCAGAATCAGAAGAAAAAAGTGAAGAGACCATCAAAGTAGGGATTCTCCACAGCTTGAGTGGTAC
GGAGATCTTTATTAAAACAATTGAAATTCTTCCTCTATATGGTACTCAAGTAGTCTTAGTCTTTTTCTTTTCACTTCTCTGGTAGTTCATCCCTAAGAGTGTCGAACTCACCATG
        130       140       150       160       170       180       190       200       210       220       230       240
       M  S  I  S  E  V  S  L  K  D  A  E  L  M  A  I  E  E  I  N  N  N  G  G  V  L  G  K  K  L  E  P  I  V  E  D  G  A  S  D
GATGTCAATCTCAGAGTTTCCTTAAAAGATGCCGAATTAATGGCGATCGAAGAGATCAACAACAATGGCGGTGTTAGGTAAAAAGTTAGAACCGATCGTGGAAGATGGCGCCTCAGA
CTACAGTTAGAGTCTCAAAGGAATTTTCTACGGCTTAATTACCGCTAGCTTCTTCTAGTTGTTGTTACCGCCACAATCCATTTTTCAATCTTGGCTAGCACCTTCTACCGCGAGTCT
        250       260       270       280       290       300       310       320       330       340       350       360
       W  P  T  F  A  E  K  A  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAAACTTTTACAGAAGGACAAAGTTGGCAGTAATTTTCGGCGTTGACCTTCCCAGTCGTCGAAGAAATAA
GACCGGCTGAAGCGACTTTTCCGATTCTTTGAAAATGTCTTCCTGTTCCACCGTCATTAAAAGCCGCAACCTGGAGCCGTTCAGCGTTTCGGCATGAGAGGTCAGCAGCTTCTTTATT
        370       380       390       400       410       420       430       440       450       460       470       480
       G  L  L  F  Y  P  V  Q  Y  Q  G  L  E  S  S  P  N  I  F  Y  M  G  A  A  P  N  Q  Q  I  V  P  A  V  K  W  L  F  D  N  G
TGGGCTTCTCTTCTATCCGGTTCAGTGTACTCAGGGTCTCGAAAGTTCCCAAATATCTTTTACATGGGCGCCGCCCCAAACCAGCAGATCGTGCCAGCAGTTAAATGGCTCTTCGACAACGG
ACCCGAAGAAGATAGGCCAAGTCATAGTCCCAGAGCTTTCAAGGGTTTATAGAAAATGTACCCGCGGCGGGTTTGGTCGTCTAGCACGGTCGTCAATTTACCGAGAAGCTGTTGCC
        490       500       510       520       530       540       550       560       570       580       590       600
       K  K  R  F  Y  L  L  G  S  D  Y  Y  V  F  P  R  T  A  N  K  I  I  K  A  Y  L  K  Y  L  G  G  V  V  V  G  E  E  Y  T  P  C
TAAGAAGCGTTTCTACCTCTTGGGCTCGGATTATGTATTCCCACGCACAGCAAACAAGATTATTAAGGCATACCTCAAATACCTCGGCGTGTTGTAGTAGTGAAGAATACACCCATG
ATTCTTCGCAAAGATGGAGAACCCGAGCCTAATACATAAGGGTGCGTGTCGTTTGTCAGCAGCATTATGGAGCCGCCACAACATCATCCACTTCTTATGTGGGGTAC
        610       620       630       640       650       660       670       680       690       700       710       720
       G  H  T  D  Y  S  S  V  I  N  K  I  K  A  A  K  P  D  V  V  F  N  T  L  N  G  D  S  N  V  A  F  F  K  Q  L  K  D  A  G
TGGTCACACTGACTATAGTTCTGTCATTAATAAAATCAAAGCCGCAAAGCCGGATGTCGTATTTAACACTCTGAACGGGGATAGTAACATGGAAGCCTTTTTCAAGCAATTAAAGGATGCCGG
ACCAGTGTGACTGATATCAAGACAGTAATTATTTTAGTTTCGGCGTTTCGGCTACAGCATAAAATGTGAGACTTGCCCTATCATCATTACATCGGAAAAAGTTCGTTAATTCCTACGGCC
        730       740       750       760       770       780       790       800       810       820       830       840
       I  D  A  N  T  L  P  V  M  S  V  S  I  A  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGATCAAAGGCATTGGTCCAGAGTATTTAAAAGGTCATCTGGTCACATGGAACTATTTCCAAAGTGTAGA
CTAACTGCGTTTATGTGAGGGACAGTACTCGCACTGTAGCGCGTCCGTAACCAGTCTCATAAATTTTCCAGTAGACCAGTTGATAAAGGTTTCACATCT
        850       860       870       880       890       900       910       920       930       940       950       960
```

```
        270                 280                 290                 300
T P E N K E F V E K Y K K K Y G E D R V T D D P I E A A Y I G V Y L W A K A V E
TACACCGGAAAACAAGGAGTTCGTTGAGAAATATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTTATATTCTTTTCATACCCCTCCTGGCCCACTGTCTACTGGGTTAGCTCCGCCATATGAATACCCGATTTCGCCAACT
     970         980         990        1000        1010        1020        1030        1040        1050        1060        1070        1080

310                 320                 330                 340
K A G S T D V D K V R E A A K G I E F N A P E G P V K I D G D N Q H L Y K T V R
GAAGGCGGGGTCGACAGACGTGGATAAGGTCCGGGAGGCCGCGAAGGGCATCGAATTTAACGCCCCAGAGGGCCCAGTAAAGATTGACGGCGACAACCAGCACCTCTACAAGACGGTGCG
CTTCCGCCCAGCTGTCTGCACCTATTCCAGGCGCCTTCCCGGAGCTTAAATTGCGGGGTCTCCCGGGTCATTTCTAACTGCCGCTGTTGGTCGTGGAGATGTTCTGCCACGC
    1090        1100        1110        1120        1130        1140        1150        1160        1170        1180        1190        1200

350                 360                 370                 380
I G E I L E N G Q I R E L W K T N K P V K P D P Y L K G Y E W A Q G L S E Q G G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGTTAAGCAGCAAGGTGG
ATAACCACTCTAGGACCTCTCGACCATTTGTTATTTGGTCTAGGTATCAATTTGGTTCAATTTGTTCTAGGTATAAATTTTCCAATACTTACCCGTCCCCAATTCGCTCGTTCCACC
    1210        1220        1230        1240        1250        1260        1270        1280        1290        1300        1310        1320

390
S H H H H H * *
TTCACATCATCATCATCATTAATGAAAGGGCGATATCCAGCACACTGGCGTCGGCCGTTACTAGTGGATCCGGCTGCTAACAAAGCCCGAAAGGAAGCTGAGTTGGCTGCTGCCACCGCT
AAGTGTAGTAGTAGTAGTAGTAATTACTTTCCCGGTAGGTCGTGTGACCGCTATAGGCCGACTAGGCCAATGATCACCTAGCTGGACCGACGATTGTTTCGGGCTTTCCTTCGACTCAACGACGACGGTGCCGA
    1330        1340        1350        1360        1370        1380        1390        1400        1410        1420        1430        1440

GAGCAATAACTAGCATAACCCCTTGGGCCTCTAAACGGGTCTTGAGGGGTTTTTTGCTGAAAGAGGAACTATATCCGGAGGACTCCCACGGCACGTTG
CTCGTTATTGATCGTATTGGGAGAACCCCGAGATTTGCCCAGAACTCCCCAAAAAACGACTTTCCTCCTTGATATAGGCCTCGCTGAGGGTGCCGTGCAAC
    1450        1460        1470        1480        1490        1500        1510        1520        1530        1540
```

FIG. 63 (Continued)

FIG. 64 - Exemplary Expression Construct for csUBP7_186C.5

```
              270                           280                          290                          300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAAACAAGGAGTTCGTTGAGAAGTATAAGAAAAGTATGGGAGGAGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTCATATCCCTCTGGCCCACTGTCTACTGGGTTAGCTCCGCCGTATGTAGCCGCATATGAATACCCGATTTCGCCAACT
       970         980         990         1000        1010        1020        1030        1040        1050        1060        1070        1080

310                           320                          330                          340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCAGAGGGCCCAGTAAAGATTGACGGCGACACCTCTACAAGACGGTGCG
CTTCCGCCCCAGCTGTCTGCACCTATTCCAGGCGCGCTTCCCGTAGCTTAAATTGCGGGTCTCCCGGGTCATTTCTAACTGCCGCTGTTGGTCGTGGAGATGTTCTGCCACGC
       1090        1100        1110        1120        1130        1140        1150        1160        1170        1180        1190        1200

350                           360                          370                          380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
ATAACCACTCTAGGACCTCTCGGACCTCTTGCCAGTTTAAGCACTCAACACCTTTGTTATTTGTCTAGGTATAAATTTCCAATACTTACCCCGTCCCCAATTCGCTCGTTCCACC
       1210        1220        1230        1240        1250        1260        1270        1280        1290        1300        1310        1320

390
S  H  H  H  H  H  *  *
TTCACATCATCATCATCATTAATGAAAGGGCGATATCCAGCACACTGGCCGCCGTTACTAGTGGATCCGGCTGCTAACAAGCCCGAAAGGAAGCTGAGTTGGCTGCTGCCACCGCT
AAGTGTAGTAGTAGTAGTAGTAATTACTTTCCCGCTATAGGTCGTGTGACCTAGCCGACGATTGTTCGGGCTTTCCTTGACTCAACCGACGACGGTGCCGA
       1330        1340        1350        1360        1370        1380        1390        1400        1410        1420        1430        1440

GAGCAATAACTAGCATAACCCCTTGGGCCTCTAAACGGGTCTTTGAGGGGTTTTTTGCTGAAAGAGGAACTATATCCGGAGGACTCCCACGGCACGTTG
CTCGTTATTGATCGTATTGGGGAACCCCGAGAATTGCCCAGAAACGACTTTCCTTGATATAGGCCTCGCTGAGGGTGCCGCGTGCAAC
       1450        1460        1470        1480        1490        1500        1510        1520        1530        1540
```

FIG. 64 (Continued)

FIG. 65 - Exemplary Expression Construct for csUBP7_186C.6

```
      T  P  E  N  K  E  F  V  E  K  Y  K  K  Y  G  E  D  R  V  T  D  D  P  I  E  A  A  Y  I  G  V  Y  L  W  A  K  A  V  E
      270                             280                             290                             300
TACACCGGAAAACAAGGAGTTCGTTGAGAAATATAAGAAAAAGTATGGGGAGGACCGGGTCGACAGATGACCAATCGAGGCGGCATACATCGGCGTATACTTATGGGCTAAAGCGGTTGA
ATGTGGCCTTTGTTCCTCAAGCAACTCTTTTATATTCTTTTTCATATCCCTCCTGGCCCACTGTCTACTGGGTTAGCTCCGCTATGTAGCCGCATATGAATACCCGATTTCGCCAACT
      970           980           990          1000          1010          1020          1030          1040          1050          1060          1070          1080

K  A  G  S  T  D  V  D  K  V  R  E  A  A  K  G  I  E  F  N  A  P  E  G  P  V  K  I  D  G  D  N  Q  H  L  Y  K  T  V  R
      310                             320                             330                             340
GAAGGCGGGGTCGACAGACGTGGATAAGGTCCGGGAGGCCGCGAAAGGGCATCGAATTTAACGCCCAGTAGGGCCCAGTAAAGATTGACGGCGACAACCAGCACCTCTACAAGACGGTGCG
CTTCCGCCCAGCTGTCTGCACCTATTCCAGGCGCCCTCCCGGCGCTTCCGTAGCTTAAATTGCGGGTCTCATTTCTAACTGCCGCTGTTGGTCGTGGAGATGTTCTGCCACGC
     1090          1100          1110          1120          1130          1140          1150          1160          1170          1180          1190          1200

I  G  E  I  L  E  N  G  Q  I  R  E  L  W  K  T  N  K  P  V  K  P  D  P  Y  L  K  G  Y  E  W  A  Q  G  L  S  E  Q  G  G
      350                             360                             370                             380
TATTGGTGAGATCCTCGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTTAAGCACTCAACACCTTTTGTTATTTGTCTAGTGTATAAATTTTCCAATACTTACCCGTGTCCCAATTCGCTCGTTCCACC
     1210          1220          1230          1240          1250          1260          1270          1280          1290          1300          1310          1320

S  H  H  H  H  H  *  *
      390
TTCACATCATCATCATCATCATTAATGAAAGGGCGATATCCAGCACACTGGGCCGGCCGTTACTAGTGGATCCGGCTGCTAACAAGCCCGAAAGGAAGCTGAGTTGGCTGCTGCCACCGCT
AAGTGTAGTAGTAGTAGTAGTAATTACTTTCCCGCTATAGGTCGTGTGACCCGGCCAATGATCACCTAGCCCGACGATTGTTTCGGGCTTTCCTTGACTCAACCGACGACGGTGCCGA
     1330          1340          1350          1360          1370          1380          1390          1400          1410          1420          1430          1440

GAGCAATAACTAGCATAACCCCTTGGGCCTCTAAACGGGTCTTTGAGGGGTTTTTTGCTGAAAGAGGAACTATATCCGGAGGCGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGTGCAAC
     1450          1460          1470          1480          1490          1500          1510          1520          1530          1540
```

FIG. 65 (Continued)

FIG. 66 - Exemplary Expression Construct for csUBP7_18GC.7

```
CGCTTGGGACTGCCATAGCCTGGCCCGGTGATGCCGGCCACGATGCTCGGCGGTAGAGGATCGAGATCTCGATCCCGCGTAGAGGATTAATACAGACTCACTATAGGGAGACCACAACGGTTTC
GCGAACCCTGATCCGACGGTATCCGGGCCACTACGGCCGTGCTACGGCCCATCCTAGAGCTAGGCGCCATTTAATTATGCTGAGTGATATCCCTCGTGTTGCCAAAG
          10         20         30         40         50         60         70         80         90        100        110        120

CCTCTAGAAATAATTTTGTTAACTTTAAGAAGGAGATATACCATGAGTTCATCAGAGAATCAGAAAAAGTGAAGAGACCATCAAAGTAGGATTCTCCACAGCTTGAGTGGTAC
GGAGATCTTTATTAAAACAAATTGAAATTCTTCCTCATATGTACTCAAGTAGTCTTAGTCTTTTTCTTTTTCACTTCTCTGGTAGTTTCATCCTAAGAGAGTGTCGAACTCACCATG
                                                          M  S  S  S  E  K  K  S  E  E  T  I  K  V  G  I  L  H  S  L  S  G  T
                                                                                          10                      20
         130        140        150        160        170        180        190        200        210        220        230        240

GATGTCAATCATTGAAGTTTCCTTAAAAGATGCCGAATTAATGGCCATCGAAGAGATCAACAACATAATGGCGGTGTGTTAGGTAAAAAGTAGAACCGATGCTGGAAGATGGCGCCTCAGA
CTACAGTTAGTAACTTCAAAGGAATTTTCTACGGCTTAATTACCGGTAGTTCTCTAGTTGTTATACCGCCACACAATCATTTTCAATCTTGGCTAGCACCTTCTACCGCGGAGTCT
M  S  I  I  E  V  S  L  K  D  A  E  L  M  A  I  E  E  I  N  N  N  G  V  L  G  K  K  L  E  P  I  V  E  D  G  A  S  D
         30                       40                           50                          60
         250        260        270        280        290        300        310        320        330        340        350        360

CTGGCCGACCTTCGCTGAAAAGGCTAAGAAACTTTTACAGAAGGACAAGGTTGCAGTAATTTTCGGCGCTTGACCTGCCAAAGCCGTTCGGCATGAGAGGTCAGCAGCTTCTTTTATT
GACCGGCTGAAGCGACTTTTCCGATTCTTTGAAAATGTCTTCCTGTTCCACCGTCATTAAAAGCCGCGAACCTGACCGTTCGGCATGAGAGGTCAGCAGCTTCTTTTATT
W  P  T  F  A  E  K  A  K  K  L  L  Q  K  D  K  V  A  V  I  F  G  A  W  T  S  A  S  R  K  A  V  L  P  V  V  E  E  N  N
     70                           80                           90                         100
         370        380        390        400        410        420        430        440        450        460        470        480

TGGGCTTCTCTCTATCCGGTTCAGTAGTTCAGTGAAGTCTCGAAAGTTCCCAAATATCTTTACATGGGCGCCGCCCCAAACCAGCAGATCGTGCCAGCAGTTAAATGCCTCTTCGACAACGG
ACCCGAAGAGATAGGCCAAGTCATACTTCAGAGCTTTCAAGGGGTTATAGAAATGTACCGCGGGGTTTGGTCGTCTAGCACGTCGTCAATTTACCGAGAAGCTGTTGCC
G  L  L  F  Y  P  V  Q  Y  E  G  L  E  S  S  P  N  I  F  Y  M  G  A  A  P  N  Q  Q  I  V  P  A  V  K  W  L  F  D  N  G
        110                       120                          130                          140
         490        500        510        520        530        540        550        560        570        580        590        600

TAAGAAGCGTTTCTACCTCTGGGCTCGGATTATGATTATTCCCACGCACAGCAGACCGCGTGCGTGTTCGTTTGTCTAATATTCGATTAAAGGCATACCTCAAATACCTCGGCGGTGTTGTAGTAGTGAAGAATACACCCCATG
ATTCTTCGCAAGATGAGAACCCGAGCCTAATACATAAGGGTGCGTTTCAAGGGTTTATGAAGTTTATGAGCCGCCACAACATCATCCACTTCTTATGTGGGGTAC
K  K  R  F  Y  L  L  G  S  D  Y  V  F  P  R  T  A  N  K  I  I  K  A  Y  L  K  Y  L  G  G  V  V  V  G  E  E  Y  T  P  C
       150                        160                        170                          180
         610        620        630        640        650        660        670        680        690        700        710        720

TGGTCACACTGACTATAGTTCTGTCATTAATAAATCAAAGCCGCAAAGCCGAAGCGTCGTATTTAACACTCTGAACGGGATAGTAGCCTTTTTCAAGCAATTAAAGGATGCCGG
ACCAGTGTGACTGATATCAAGACACAGTATATTTAGTTTTCGGCGTTCGGCTTCGCAGCATAAAGTTGTAGACATTACATCGGAAAAAGTTCGTTAATTCCTACGGCC
G  H  T  D  Y  S  S  V  I  N  K  I  K  A  A  K  P  D  V  V  F  N  T  L  N  G  D  S  N  V  A  F  F  K  Q  L  K  D  A  G
       190                        200                         210                           220
         730        740        750        760        770        780        790        800        810        820        830        840

GATTGACGCAAATACACTCCCTGTCATGAGCCGTGAGCATCCGCCGGAGGAGATCAAAGGCATTGGTCCAGAGTATTTAAAAGGTCATCTGGTCACATGTACCTTGATAAAGTTCACATCT
CTAACTGCGTTTATGTGAGGGACAGTACTCCGCACTCGTAGCGGCGCCTAGCCACGATCTCTAGTTCCGTAACCAGTCTCATAAATTTCCAGTGGTACCAGTGGAACTTCAAAGTTTCAAGTT
I  D  A  N  T  L  P  V  M  S  V  S  I  A  A  E  E  I  K  G  I  G  P  E  Y  L  K  G  H  L  V  T  W  N  Y  F  Q  S  V  D
      230                        240                          250                          260
         850        860        870        880        890        900        910        920        930        940        950        960
```

```
              270                         280                         290                         300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAACAAGGAGTTCGTTGAGAAGTATAAGAAAAAGTATGGGGAGGACCGGGTTGACAGATGACCCAATCGAGGCGGCATACATCGGCGTATACTTATGGGCTAAAGCGGTTGA
ATGTGGCCTTTGTTCCTCAAGCAACTCTTTATATTCTTTTCATATGGGTTAGCTCCGCCGTATGTAGCCGCATATGAATACCCGATTTCGCCAACT
   970         980         990         1000        1010        1020        1030        1040        1050        1060        1070        1080

310                         320                         330                         340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCAGAGGGCCCAGTAAAGATTGACGGCGACAACCAGCACCTCTACAAGACGGTGCG
CTTCCGCCCAGCTGTCTGCACCTATTCCAGGCCCTCCGGCGCTTCCGTAGCTTAAATTGCGGGTCTCATTTCTAACTGCCGCTGTTGGTCGTGGAGATGTTCTGCCACGC
   1090        1100        1110        1120        1130        1140        1150        1160        1170        1180        1190        1200

350                         360                         370                         380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTGAAGCACTCAACACCTTTTGTTTATTTGTCTAGTGATCAATTTGGTAGCATCACAAATTTTCCAATACTTACCCGTGTCCCCAATTCGCTCGTTCCACC
   1210        1220        1230        1240        1250        1260        1270        1280        1290        1300        1310        1320

390
S  H  H  H  H  H  *  *
TTCACATCATCATCATCATTAATGAAAGGGCGATATCCAGCACACTGGGCGTCGGCCGTTACTAGTGGATCCGGCTGCTAACAAAGCCCGAAAGGAAGCTAGTTGGCTGCTGCCACCGCT
AAGTGTAGTAGTAGTAGTAGTAATTACTTTCCCGCTATAGGTCGTGTGACCCTAGGCCGCAATGATCACCTAGACTCAACCGACGATTGTTTCGGGCTTTCCTTCGACTCAACCGACGACGGTGCCGA
   1330        1340        1350        1360        1370        1380        1390        1400        1410        1420        1430        1440

GAGCAATAACTAGCATAACCCCCTTGGGCCTCTAAACGGGTCTTTGAGGGGTTTTTTGCTGAAAGAGGAACTATATCCGGAGGCGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGTGCAAC
   1450        1460        1470        1480        1490        1500        1510        1520        1530        1540
```

FIG. 66 (Continued)

FIG. 67 - Exemplary Expression Construct for csUBP7_186C.8

```
        Q  S  V  D  T  P  E  N  K  E  F  V  E  K  Y  K  K  K  Y  G  E  D  R  V  T  D  D  P  I  E  A  A  Y  I  G  V  Y  L  W  A
        CCAAAGTGTAGATACACCGGAAAACAAGGAGTTCGTTGAGAAATATAAGAAAAAGTATGGGAAGGACCGGGTGACAGATGACCCAATCGAGGCGGCATACATCGGCGTATACTTATGGC
        GGTTTCACATCTATGTGGCCTTTTGTTCCTCAAGCAACTCTTTATATTCTTTTTCATACCCTTCCTGGCCCACTGTCTACTGGTTAGCTCCGCGTTAGCCGCATAGTGAATACCCG
            970       980       990      1000      1010      1020      1030      1040      1050      1060      1070      1080

K  A  V  E  K  A  G  S  T  D  V  D  K  V  R  E  A  A  K  G  I  E  F  N  A  P  E  G  P  V  K  I  D  G  D  N  Q  H  L  Y
        TAAAGCGGTTGAGAAGGCGGGGTCGACAGACGTGGATAAGGTCCGGGAAGGGCATCGAATTTAACGCCCCAGAGGGCCAGTAAAGATTGACGGCGACAACCAGCACTCTA
        ATTTCGCCAACTCTTCCGCCAGCTGTCTGCACCTATTCCAGGCCTCCGGGCGCTTCCCGTAGCTTAAATTGCAGGCTCATTCTAACTGCCGCTGTTGGTCGTGTGAGAT
           1090      1100      1110      1120      1130      1140      1150      1160      1170      1180      1190      1200

K  T  V  R  I  G  E  I  L  E  N  G  Q  I  R  E  L  W  K  T  N  K  P  V  K  P  D  P  Y  L  K  G  Y  E  W  A  Q  G  L  S
        CAAGACGGTCGTATTGGTGAGATCCTGGAGAACGGTCAAATTCGTGAGTTGTGGAAAACAAATAAACCAGTTAAACCAGATCCATATTTAAAAGGTTATATGGGCACAGGGGTTAAG
        GTTCTGCCAGCCATAACCACTCTAGGACCTCTTGCCAGTTCAACACCTTTGTTATTTGGTCAATTTGGTCTAGGTATAAATTTCCAATACTTACCGTCCCCAATTC
           1210      1220      1230      1240      1250      1260      1270      1280      1290      1300      1310      1320

E  Q  G  S  H  H  H  H  H  H  *  *
        CGAGCAAGGTTCACATCATCATCATCATCATTAATGAAAGGGCGATATCCAGCACACTGGCCGGCCCGTTACTAGTAGTAGTAGTAGTGATGATCCGTAACAAAGCCCGAAAGAAGCTGAGTTGGCT
        GCTCGTTCCACCAAGTGTAGTAGTAGTAGTAGTAATTACTTTCCCGCTATAGGTCGTGACCGCCGGCAATGATCACCTAGGCCGACGATTGTTTCGGCTTTCCTTCGACTCAACCGA
           1330      1340      1350      1360      1370      1380      1390      1400      1410      1420      1430      1440

GCTGCCACCGCGTGAGCAATAACTAGCATAACCCCTTGGGCGCCTCTAAACGGTCTCTTGAGGGTTTTTTGCTGAAAGGAGGAACTATATCCGAGCGACTCCCACGCACGTTGGCAAGCT
        CGACGGTGGCACTCGTTATTGATCGTATTGGGAACCCCGGAGATTTGCCCAGAACTCCCCAAAAAACGACTTTCCTCCTTGATATAGGCCTCGCTGAGGTGCCGTGCCAACCGTTCGA
           1450      1460      1470      1480      1490      1500      1510      1520      1530      1540      1550      1560

CGGAATTC
GCCTTAAG

FIG. 67 (Continued)
```

FIG. 68 - Exemplary Expression Construct for csUBP7_18GC.9

```
CGCTTGGGACTGCCATAGCCTGGCCCGGTGATGCCGGCCACGATGCTCGATCGAGATCTCGATCCCGCGTAGAGATAAGAGATCTCACTACAGAGGAGACCACAACGGTTTC
GCGAACCCTGATCCGACGGGTATCCGGGCCACTACGGCCGTGCTACCGCAGGCCCATCCTCCTAGCTCTTAGAGCTAGGGCGCTTTAATTATGCTGAGTGATATCCCTCGTGTTGCCAAAG
         10        20        30        40        50        60        70        80        90       100       110       120

M  S  S  S  E  K  E  K  S  E  E  T  I  K  V  G  I  L  H  S  L  S  G  T
CCTCTAGAAATAATTTGTTTAACTTTAAGAGGAGATATACCATGAGTAGTTCATCAGAGAATCAGAAAGAAAAGTGAAGAGACCATCAAAGTAGGAGGATTCTCCACAGCTTGAGTGGTAC
GGAGATCTTTATTAAACAAATTGAAATTCTCCTCTATATGGTACTCAAGTAGTCTTCAAGTAGTCTTTTCTTTTCACTTCTCTGGTAGTTCATCCTAAGACGTGTCGAACTCACCATG
        130       140       150       160       170       180       190       200       210       220       230       240

M  S  I  S  E  V  S  L  K  D  A  E  L  M  A  I  E  E  I  N  N  N  G  V  L  G  K  K  L  E  P  I  V  E  D  G  A  S  D
GATGTCAATCTCAGAGTTCTCCTTAAAGATGCCGAATTAATGGCCATCGAAGAGATCAACAACAATGGCGGTGTTAGGTAAAAAGTTAGAACCGATCGTGGAAGATGGCGCCTCAGA
CTACAGTTAGAGTCTCAAGAGGAATTTCTACGGCTTAATTACCGGTAGCTTCTAGTTGTTGTTATTACCGCCACAATCCATTTTTCAATCTTGGCTAGCACCTTCTACCGCGGAGTCT
        250       260       270       280       290       300       310       320       330       340       350       360

W  P  T  F  A  E  K  A  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAAACTTTTACAGAAGGACAAAGTGGCAGTAATTTTCGGCGCTTGGACCTCGGCAAGTCGCAAAGCCGTACTCCCAGTCGTCGAAGAAATAA
GACCGGCTGAAGCGACTTTTCCGATTCTTTGAAAATGTCTTCCTGTTCCACCGTCATTAAAAGCCGCGAACCTGGAGCCGTTCAGCGTTTCGGCATGAGAGGTCAGCAGCTTCTTTATT
        370       380       390       400       410       420       430       440       450       460       470       480

G  L  L  F  Y  P  V  S  Y  E  G  L  E  S  S  P  N  I  F  Y  M  G  A  A  P  N  Q  Q  I  V  P  A  V  K  W  L  F  D  N  G
TGGGCTTCTCTTCTATCCGGTTAGCTATGAAGGTCTCGAAAGTTCCCAAATATCTTTTACATGGGAGCGCCCCCAAACCAGCAGATCGTGCCAGCAGTTAAATGGCTCTTCGACAACGG
ACCCGAAGAGATAGGCCAATCGATACTTCCAGAGCTTTCAAGGGGTTTAGAAAATGTACCCCTCGCGGGGTTTGGTCGTCTAGCACGGTCGTCAATTTACCGGAAGCTGTTGCC
        490       500       510       520       530       540       550       560       570       580       590       600

K  K  R  F  Y  L  L  G  S  D  Y  V  F  P  R  T  A  N  K  I  I  K  A  Y  L  K  Y  L  G  G  V  V  V  G  E  E  Y  T  P  C
TAAGAAGCGGTTTCTACCTCTTGGGCTCGGATTATGTATTCCCACGCACAGCAAACAAGATTATTAAGGCATACCTCAAATACCTCGGCGTGTTGTAGTAGTGAAGAATACACCCATG
ATTCTTCGCAAAGATGGAGAATGGAGAACCCGAGCCTAATACATAAGGGTGCGTGTCGTTTGTTCTAATAATTCCGTATGGAGTTATGGAGCCGCCACAACATCATCCACTTCTTATGTGGGGTAC
        610       620       630       640       650       660       670       680       690       700       710       720

G  H  T  D  Y  S  S  V  I  N  K  I  K  A  A  K  P  D  V  V  F  N  T  L  N  G  D  S  N  V  A  F  F  K  Q  L  K  D  A  G
TGGTCACACTGACTATAGTTCTGTCATTAATAAAATCAAAGCCGCAAAGCCGGATGTCGTATTAACACTCTGAACGGGATAGTAGCCTTTTTCAAGCAATTAAAGGATGCCGG
ACCAGTGTGACTGATATCAAGACAGTAATTATTTTTAGTTTCGGCGTTCGGCTACAGCATAAATGTGAGACTTGCCCATCATTACATCGGAAAAAGTTCGTTAATTCCTACGGCC
        730       740       750       760       770       780       790       800       810       820       830       840

I  D  A  N  T  L  P  V  M  S  V  S  I  A  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGATCAAAGGCATTGGTCCAGAGTATTTAAAAGGTCATCTGTCACATGAACTATTCCAAAGTGTAGA
CTAACTGCGTTTATGTGAGGGACAGTACTCGCACTCGTAGCGCCTCCTCTAGTTTCCGTAACCAGTCTCATAAATTCCCGGAATAGATCTTGATAAAGGTTCACATCT
        850       860       870       880       890       900       910       920       930       940       950       960
```

```
        270                     280                     290                     300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAACAAGGAGTTCGTTGAGAAGTATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTTATATTCTTTTTCATATCCCCTCCTGGCCCACTGTCTACTGGGTTAGCTCCGCCGTATGTAGCCGCATATGAATACCCGATTTCGCCAACT
   970         980         990        1000        1010        1020        1030        1040        1050        1060        1070        1080
        310                     320                     330                     340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCAGAGGGCCCAGTAAAGATTGACGGCGACAACCAGCACCTCTACAAGACGGTGCG
CTTCCGCCCCAGCTGTCTGCACCTATTCCAGGCCCTCCGGCGCTTCCCGTAGCTTAAATTGCGGGTCTCATTTCTAACTGCCGCTGTTGGTCGTGGAGATGTTCTGCCACGC
  1090        1100        1110        1120        1130        1140        1150        1160        1170        1180        1190        1200
        350                     360                     370                     380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
ATAACCACTCTAGGACCTCTTGCCAGTTAAGCACTCAACACCTTTGTTATTTGTCTAGGTATAAAATTTCCAATACTTACCCGTGTCCCCAATTCGCTCGTTCCACC
  1210        1220        1230        1240        1250        1260        1270        1280        1290        1300        1310        1320
        390
S  H  H  H  H  H  *  *
TTCACATCATCATCATCATCATTAATGAAAGGGCGATATCCAGCACTGGCGTCCGGCCGTTACTAGTGGATCCGGCTGCTAACAAAGCCCGAAAGGAAGCTGAGTTGGCTGCTGCCACCGCT
AAGTGTAGTAGTAGTAGTAGTAATTACTTCCCGGTATAGGTCGTGTGACCGCTATAGGTCGTGACCGCCAATGATCACCTAGCCGACGATTGTTTCGGGCTTTCCTTCGACTCAACCGACGACGGTGCCGA
  1330        1340        1350        1360        1370        1380        1390        1400        1410        1420        1430        1440

GAGCAATAACTAGCATAACCCCTTGGGCCTCTAAACGGGTCTTTTTTGCTGAAAGAGGAACTATATCCGGAGGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGCGTGCAAC
  1450        1460        1470        1480        1490        1500        1510        1520        1530        1540
```

FIG. 68 (Continued)

FIG. 69 - Exemplary Expression Construct for csUBP7_18GC.10

```
CGCTTGGGACTGCCATAGCCTGGCCCGGTGATGCCGGCCACGATGCTCGATCTCGATCGATCTCGATCCCGCGTAGAGGATTAATACGACTCACTATAGGGAGACCACAACGGTTTC
GCGAACCCTGACGCGTATCCGACCGGGCCCACTACGGCCCGTGCTACGACCCGCATCCTCTAGCTCCTAGCGCCTAGGGCGCTTTAATTATGCTGAGTGATATCCCTGTGTTGCCAAAG
         10        20        30        40        50        60        70        80        90       100       110       120

CCTCTAGAAATAATTTTGTTTAACTTTAAGAAGGAGATATACCATGAGTTCATCAGAATCAGAAAAAGAAGAGACCATCAAAGTAGGAGATTCTCCACAGCTTGAGTGGTAC
GGAGATCTTTATTAAAACAAATTGAAATTCTTCCTCTATATGGTACTCAAGTAGTCTTAGTCTTTCTTTTTCACTTCTCTGGTAGTTCATCCTAAGAGTGTCGAACTCACCATG
        130       140       150       160       170       180       190       200       210       220       230       240
                                                  M  S  S  S  E  K  K  S  E  E  T  I  K  V  G  I  L  H  S  L  G  T
                                                                            10                    20

GATGTCAATCTCAGAAGTTCCTTAAAAGATGCCGAATTAATGGCGATCGAAGAGATCAACAACATAATGGCGGTGTTAGGTAAAAAGTTAGAACCGATCGTGGAAGATGGCGCCTCGA
CTACAGTTAGAGTCTTCAAGGAATTTCTACGGCTTAATTACCGCTAGCTTGTATTACGCCACAACATCATTTTCAATCTTGGCTAGCACCTTCTACCGCGGAGTCT
        250       260       270       280       290       300       310       320       330       340       350       360
M  S  I  S  E  V  S  L  K  D  A  E  L  M  A  I  E  E  I  N  N  N  G  G  V  L  G  K  K  L  E  P  I  V  E  D  G  A  S  D
              30                              40                              50                              60

TGGCCGACCTTCGCTGAAAAGGCTAAGAAACTTTTACAGAAGGACAAGGTTGGCAGTAATTTTCGGCGCTTGGACCTTGTTAGTGTACTCGCAAAGCCGCTCGGCAAGTCGCAAGCCCGCTACTCCCAGTCGTCGAAGAAATAA
ACCGGCTGGAAGCGACTTTTCCGATTCTTTGAAAATGTCTTCCTGTTCCACCGTCATTAAAAGCCGCGAACCTGGAGCCGTTCAGCGTTTCGGCATGAGAGGTCAGCAGCTTCTTTTATT
        370       380       390       400       410       420       430       440       450       460       470       480
W  P  T  F  A  E  K  A  K  K  L  L  Q  K  D  K  V  A  V  I  F  G  A  W  T  S  A  S  R  K  A  V  L  P  V  V  E  E  N  N
                      70                              80                              90                             100

TGGGCTTCTCTCTATCCGGTTAACTATGAAGGTCTCGAGAGTTCCCGAAAGTTCCCCAAATATCTTTACATGGGCGCCGCCCAAACCAGCAGATCGTGCCAGCAGTTAAATGGCTCTTCGACAACGG
ACCCGAAGAGAAGATAGGCCAATTGATACTTCAAGGGGTTATAGAAATGTACCCGCGGGGTTTGGTCGTCTAGCACGTCGTCAATTTACCGAGAAGCTGTTGCC
        490       500       510       520       530       540       550       560       570       580       590       600
G  L  L  F  Y  P  V  N  Y  E  G  L  E  S  S  P  N  I  F  Y  M  G  A  A  P  N  Q  Q  I  V  P  A  V  K  W  L  F  D  N  G
            110                             120                             130                             140

AAGAAGCGGTTCTACCTCTTCGGATTATGTATTCCACGCGACAGCAGACATACCTCAAATACCTCGGCGGTGTTGTAGTAGTGAAGAATACACCCCATG
ATTCTTCGCAAAGATGGAGAACCCGAGCCTAATACATAAGGGGCTGCGTTGCTTGTCTCAATAATTCCGTATGGAGTTATGGAGCCGCCACAACATCATCCACTTCTTATGTGGGGTAC
        610       620       630       640       650       660       670       680       690       700       710       720
K  K  R  F  Y  L  L  G  S  D  Y  V  F  P  R  T  A  N  K  I  I  K  A  Y  L  K  Y  L  G  G  V  V  V  G  E  E  Y  T  P  C
                    150                             160                             170                             180

TAAGAAGCGTTTCTACCTCTTGGGCTCGGATTATGTATTCCACGCGACAGCCGTGTTGTTGTAGTAGTGAAGAATACACCCCATG
ATTCTTCGCAAAGATGGAGAACCCGAGCCTAATACATAAGGGTGCGT
TGGTCACACTGACTATAGTTCTGTCATTAATAAATCAAAGCCGCAAAGCCGCAGACGTTCGGTCTGCAGCATAAATGTTTAACACTCTGAACGGGATAGTAGCCTTTTTCAAGCAATTAAAGGATGCCGG
ACCAGTGTGACTGATATCAAGACAGTAATTATTTTAGTTTCGGCGTTCGGTCGCAGACTTGTGAGACTTGCCCATCATTACATCCGGAAAAAGTTCGTTAATTCCTACGGCC
        730       740       750       760       770       780       790       800       810       820       830       840
G  H  T  D  Y  S  S  V  I  N  K  I  K  A  A  K  P  D  V  V  F  N  T  L  N  G  D  S  N  V  A  F  F  K  Q  L  K  D  A  G
            190                             200                             210                             220

TGGTCACACTGACTATAGTTCTGTCATTAATAAATCAAAGCCGCAAAGCCGCAGACGTTCGGTCTGCAGCATAAATGTTTAACACTCTGAACGGGATAGTAGCCTTTTTCAAGCAATTAAAGGATGCCGG
ACCAGTGTGACTGATATCAAGACAGTAATTATTTTAGTTTCGGCGTTCGGTCGCAGACTTGTGAGACTTGCCCATCATTACATCCGGAAAAAGTTCGTTAATTCCTACGGCC
        850       860       870       880       890       900       910       920       930       940       950       960
I  D  A  N  T  L  P  V  M  S  V  S  I  A  E  E  E  I  K  G  I  G  P  E  Y  L  K  G  H  L  V  T  W  N  Y  F  Q  S  V  D
                    230                             240                             250                             260
```

```
       270                         280                          290                            300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAAACAAGGAGTTCGTTGAGAAATATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTTCATATCCCCTCCTGGCCCACTGTCTACTGGGTTAGCTCCGCCGTATGTAGCCGCATATGAATACCCGATTTCGCCAACT
    970        980        990       1000       1010       1020       1030       1040       1050       1060       1070       1080

310                         320                          330                            340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCAGAGGGCCCAGTAAAGATTGACGGCGACAACCAGCACCTCTACAAGACGGTGCG
CTTCCGCCCCAGCTGTCTGCACACTATTCCAGGCCTCTGCACCTATTCCGGGCGCTTCCCGTAGCTTAAATTGCGGGGTCTCATTTCTAACTGCCGCTGTTGGTCGTGGAGATGTTCTGCCACGC
   1090       1100       1110       1120       1130       1140       1150       1160       1170       1180       1190       1200

350                         360                          370                            380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTTAAGCACTCAACACCTTTGTTATTTGGTCAGTTATGGTTATAAATTTCCAATACTTACCCGTGTCCCCAATTCGCTCGTTCCACC
   1210       1220       1230       1240       1250       1260       1270       1280       1290       1300       1310       1320

390
S  H  H  H  H  H  *  *
TTCACATCATCATCATCATTAATGAAAGGGCGATATCCAGCACACTGGCCGTTACTAGTGGATCCGGCTGCTAACAAAGCCCGAAAGGAAGCTGAGTTGGCTGCTGCCACCGCT
AAGTGTAGTAGTAGTAGTAATTACTTTCCCGCGTATAGGTCGTGTGACCGGCCAATGATCAACCTAGGCCGACGATTGTTTCGGGCTTTCCTTCGACTCAACCGACGACGGTGCCGA
   1330       1340       1350       1360       1370       1380       1390       1400       1410       1420       1430       1440

GAGCAATAACTAGCATAACCCCCTTGGGCCTCTAAACGGGTCTTTGAGGGGTTTTTTGCTGAAAGGAGGAACTATATCCGGAGGACTCCCACGGCACGTTG
CTCGTTATTGATCGTATTGGGGAACCCGGAGATTGCCCAGAAACGACTTTCCTCCTTGATATAGGCCTCGCTGAGGGTGCCGTGCAAC
   1450       1460       1470       1480       1490       1500       1510       1520       1530       1540

FIG. 69 (Continued)
```

FIG. 70 - Exemplary Expression Construct for csUBP7_18GC.11

```
CGCTTGGGACTGCCATAGCTGGCCCGGTGATGCCGGCCACGATGCTCGATCGAGATCTCGATCCCGCGTAGAGATGATTAATACAGACTCACTATAGGGAGACCAACGGTTTC
GCGAACCCTGATCCGACGGGCCACTACGGCCGTGCTACGCAGGCCATCCTAGCTCCTAGCTAGGGCGCTTTAATTATGTGAGTGATATCCCTGGTGTTGCCAAAG
         10        20        30        40        50        60        70        80        90       100       110       120

M  S  S  S  E  K  S  E  E  T  I  K  V  G  I  L  H  S  L  G  T
CCTCTAGAAATAATTTGTTTAACTTTAAGAAGGAGATATACCATGAGTTCATCAGAATCAGAAAAAAGTGAAGAGACCATCAAAGTAGGGATTCTCCACAGCTTGAGTGGTAC
GGAGATCTTTATTAAACAAATTGAAATTCTTCCTCTATATGGTACTCAAGTAGTCTTAGTCTTTTCTTTTTCACTTCTCTGGTAGTTCATCCCTAAGAGTGTCGAACTCACCATG
        130       140       150       160       170       180       190       200       210       220       230       240

30                                   40                                   50                                  60
M   S  I  S  E  V  S  L  K  D  A  E  L  M  A  I  E  E  I  N  N  N  G  G  V  L  G  K  K  L  E  P  I  V  E  D  G  A  S  D
GATGTCAATCTCAGAAGTTCCTTAAAGATGCCGAATTAATGGCCATCGAAGAGATCAACAATAATGGCGGTGTGTTAGGTAAAAAGTTAGAACCGATCGTGGAAGATGGCGCCTCAGA
CTACAGTTAGAGTCTTCAAGGAATTTCTACGGCTTAATTACCGGTAGTTATTACTCCAGCACAAATAATCCGCCACACAATCCATTTTTCAATCTTGGCTAGCACCTTCTACCGCGGAGTCT
        250       260       270       280       290       300       310       320       330       340       350       360

70                                   80                                  90                                  100
W   P  T  F  A  E  K  A  K  K  L  L  Q  K  D  K  V  A  V  I  F  G  A  W  T  A  A  S  R  K  A  V  L  P  V  V  E  E  N  N
CTGGCCGACCTTCGCTGAAAAGGCTAAGAAACTTTTACAGAAGGACAAGGTTGCAGTAATTTTCGGCGCTTGGACCGCGAAGTCGCAAAGCCCGTACTCGTCAGTAAATAA
GACCGGCTGAAGCGACTTTCCGATTCTTTGAAAATGTCTTCCTGTTCCATTAAAAGCCGCGAACCTGGCGCGTTTCGGCATGAGAGTCAGCAGCTTCTTTTATT
        370       380       390       400       410       420       430       440       450       460       470       480

110                                  120                                 130                                  140
G   L  L  F  Y  P  V  Q  Y  E  G  L  E  S  S  P  N  I  F  Y  M  G  A  A  P  N  Q  Q  I  V  P  A  V  K  W  L  F  D  N  G
TGGGCTTCTCTCTATCCGGTTCAGTAGTGAAAGTCTCGAAAGTTCCCAAATATCTTTTACATGGGCGCCGCCCCAAACCAGCAGATCGTGCCAGCAGTTAAATGGCTCTTCGACAACGG
ACCCGAAGAGAAGATAGGCCAAGTCATCACTTCCAGAGCTTTCAAGGGGTTTATAGAAAATGTACCGCGGCGGGTTTGGTCGTCTAGCACGGTCGTCAATTTACCGAGAAGCTGTTGCC
        490       500       510       520       530       540       550       560       570       580       590       600

150                                  160                                 170                                  180
K   K  R  F  Y  L  L  G  S  D  Y  Y  V  F  P  R  T  A  N  K  I  I  K  A  Y  L  K  Y  L  G  G  V  V  V  G  E  E  Y  T  P  C
TAAGAAGCGGTTCTACCTCTTGGGCTCGGATTATGTATTCCCACGCACAGCACAAGCAAACAAGATTATTAAGGCATACCTCAAATACCTCGGCGGTGTTGTAGTAGGTGAAGAATACACCCCATG
ATTCTTCGCAAAGATGGAGACGGAGCCGAGCGTAATACATAAGGGTCGTCGTTCGTCTCGTTGTTCTCAATAATTCCGTATGGAGTTATGTGAGGCCGCCACAACATCATCCACTTCTTATGTGGGGTAC
        610       620       630       640       650       660       670       680       690       700       710       720

190                                  200                                 210                                  220
G   H  T  D  Y  S  S  V  I  N  K  I  K  A  A  K  P  D  V  V  F  N  T  L  N  G  D  S  N  V  A  F  F  K  Q  L  K  D  A  G
TGGTCACACTGACTATAGTTCTGTCATTAATAAAATCAAAGCCGCAAAGCCGGATGTCGTATTTAACACTCTGAACGGGGATAGTAGTGAACGACCTTTTTCAAGCAATTAAAGGATGCCGG
ACCAGTGTGACTGATCTAATACATAAGACAGTATTCAATTTTAGTTTCGGCGTTTCGGCCTACAGCATAAATTGTGAGACTTGCCCTATCATTACATCGGAAAAGTTCGTTAATTTCCTACGGCC
        730       740       750       760       770       780       790       800       810       820       830       840

230                                  240                                 250                                  260
I   D  A  N  T  L  P  V  M  S  V  S  I  A  E  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGGAGATCAAAGGCATTGGTCCAGAGTATTTAAAAGGTCATCTGTCACATGAACTATTCCAAAGTGTAGA
CTAACTGCGTTTATGTGAGGGACAGTACTCGCACTCGTAGCGGCTCCTCCTCTAGTTTCCGTAACCAGTCTCATAAATTTCCAGTAGACCGTAACTTGATAAAAGTTTCACATCT
        850       860       870       880       890       900       910       920       930       940       950       960
```

```
       T  P  E  N  K  E  F  V  E  K  Y  K  K  Y  G  E  D  R  V  T  D  D  P  I  E  A  A  Y  I  G  V  Y  L  W  A  K  A  V  E
     TACACCGGAAAACAAGGAGTTCGTTGAGAAGTATAAGAAAAAGTATGGGGAGGACCGGGTCGACAGATGACCAATCGAGGCGGCATAACTCGGCGTATACTTATGGGCTAAAGCGGTTGA
     ATGTGGCCTTTGTTCCTCAAGCAACTCTTTATATTCTTTTCATACCCCTCCTGGCCCACTGTCTACTGGGTTAGCTCCGCTATGTAGCCGCATATGAATACCCGATTTCGCCAACT
        970       980       990      1000      1010      1020      1030      1040      1050      1060      1070      1080

K  A  G  S  T  D  V  D  K  V  R  E  A  A  K  G  I  E  F  N  A  P  E  G  P  V  K  I  D  G  D  N  Q  H  L  Y  K  T  V  R
     GAAGGCGGGGTCGACAGACGTGGATAAGGTCCGGGAGGCCGCGAAAGGGCATCGAATTTAACGCCCCAGAGGGCCCAGTAAAGATTGACGGCGACAACCAGCACCTCTACAAGACGGTGCG
     CTTCCGCCCCAGCTGTCTGCACCTATTCCAGGCCCTCGGCGCGTTCCCGGAGCTTAAATTGCGGGTCTCATTTCTAACTGCCGCTGTTGGTCGTGGAGATGTTCTGCCACGC
       1090      1100      1110      1120      1130      1140      1150      1160      1170      1180      1190      1200

I  G  E  I  L  E  N  G  Q  I  R  E  L  W  K  T  N  K  P  V  K  P  D  P  Y  L  K  G  Y  E  W  A  Q  G  L  S  E  Q  G  G
     TATTGGTGAGATCCTCGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
     ATAACCACTCTAGGACCTCTTGCCAGTTTAAGCACTCAACACCTTTGTTATTTGGTCTAGTAATCAATTTTCCAATACTTACCCGTGTCCCAATTCGCTCGTTCCACC
       1210      1220      1230      1240      1250      1260      1270      1280      1290      1300      1310      1320

S  H  H  H  H  H  *  *
     TTCACATCATCATCATCATCATTAATGAAAGGGCGATATCCAGCACACTGGCCGTCCGGCTGCTAACAAGCCCGAAAGGAAGCTGAGTTGGCTGCTGCCACCGCT
     AAGTGTAGTAGTAGTAGTAGTAATTACTTTCCCGCTATAGGTCGTGTGACCGGCAATGATCACCTAGGCCGACGATTGTTTCGGGCTTCCTTCGACTCAACCGACGACGGTGCCGA
       1330      1340      1350      1360      1370      1380      1390      1400      1410      1420      1430      1440

GAGCAATAACTAGCATAACCCCTTGGGCCTCTAAACGGGTCTTTTTTGCTGAAAGAGGAACTATATCCGGAGGACTCCCACGGCACGTTG
     CTCGTTATTGATCGTATTGGGAGAACCCCGAGATTTGCCCAGAAACGACTTTCCTCCTTGATATAGGCCTCGCTGAGGTGCCGCGTGCAAC
       1450      1460      1470      1480      1490      1500      1510      1520      1530      1540
```

FIG. 70 (Continued)

FIG. 71 - Exemplary Expression Construct for csUBP7_18GC.12

```
                 270                         280                         290                         300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAAACAAGGAGTTCGTTGAGAAATATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTTCATACCCCTCCTGGCCACTGTCTACTGGGTTAGCTCCGCGTATGTAGCCGCATATGAATACCCGATTTCGCCAACT
     970         980         990        1000        1010        1020        1030        1040        1050        1060        1070        1080

310                         320                         330                         340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAAGGGCATCGAATTTAACGCCCAGTAAAGATTGACGGCGACAACCAGCACCTCTACAGACGGTGCG
CTTCCGCCCCAGCTGTCTGCACCTATTCCAGGCCCTCCGGCGCCCTCCCGTAGCTTAAATTGCGGGGTCTCATTTCTAACTGCCGCTGTTGGTCGTGGAGATGTCTGCCACGC
    1090        1100        1110        1120        1130        1140        1150        1160        1170        1180        1190        1200

350                         360                         370                         380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
ATAACCACTCTAGGACCTCTCTGCCAGTTTAAGCACTCAACACCTTTGTTTATTTGTCTAGTGGTCAAATTGCCAATACTTACCCCGTGTCCCCAATTCGCTCGTTCCACC
    1210        1220        1230        1240        1250        1260        1270        1280        1290        1300        1310        1320

390
S  H  H  H  H  H  *  *
TTCACATCATCATCATCATTAATGAAAGGGCGATATCCAGCACACTGGCGTCCGGCCGTTACTAGTGGATCCGGCTGCTAACAAAGCCCGAAAGGAAGCTGAGTTGGCTGCTGCCACCGCT
AAGTGTAGTAGTAGTAGTAGTAATTACTTTCCCGGCTATAGGTCGTGTGACCGCAATGATCAACCTAGCCGACGATTGTTTCGGGCTTCCTTCGACTCAACCGACGACGGTGCCGA
    1330        1340        1350        1360        1370        1380        1390        1400        1410        1420        1430        1440

GAGCAATAACTAGCATAACCCCTTGGGCCTCTAAACGGGTCTTGAGGGGTTTTTTGCTGAAAGAGGAACTATATCCGGAGCGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGCCGTGCAAC
    1450        1460        1470        1480        1490        1500        1510        1520        1530        1540
```

FIG. 71 (Continued)

FIG. 72 - Exemplary Expression Construct for csUBP7_186C.13

```
CGCTTGGGACTGCCATAGCCTGGCCCGGTGATGCCGGCCACGATGCTCGGCGTAGAGAATCGAGATCTCGATCCCGCGAATTAATACAGACTCACTATAGGGAGACCACAACGGTTTC
GCGAACCCTGACGCGGTATCCGACCGGGCCCGGTGCTACCGGCCGGTCGTGCAGGCCCATCCTAGAGCTTCCTAGAGCATGGGCGCTTTAATTATGCTGAGTGATATCCCTCGTGTTGCCAAAG
       10         20         30         40         50         60         70         80         90        100        110        120

M  S  S  S  E  K  S  E  E  T  I  K  V  G  I  L  H  S  L  G  T
CCTCTAGAAATAATTTTGTGTTAAACTTTAAGAAGGAGATATACCATGAGTTCATCAGAATCAGAAAAAAGTGAAGAGACCATCAAAGTAGGGATTCTCCACAGCTTGAGTGGTAC
GGAGATCTTTATTAAAACAAATTGAAATTCTTCCTCTATATGGTACTCAAGTAGTCTTAGTCTTTTCTTTTCACTTCTCTGGTAGTTCATCCCTAAGAGTGTCGAACTCACCATG
       130        140        150        160        170        180        190        200        210        220        230        240

M  S  I  S  E  V  S  L  K  D  A  E  L  M  A  I  E  E  I  N  N  N  G  V  L  G  K  K  L  E  P  I  V  E  D  G  A  S  D
GATGTCAATCTCAGAGTTCTCCTTAAAGATGCCGAATTAATGGCCATCGAAGAGATCAACAACAATGGCGGTGTGTTAGGTAAAAAGTTAGAACCGATCGTGGAAGATGGCGCCTCAGA
CTACAGTTAGAGTCTCAAGAGGAATTTCTACGGCTTAATTACCGGTAGCTTCTAGTTGTTGTTACCGCCACACAATCCATTTTTCAATCTTGGCTAGCACCTTCTACCGCGGAGTCT
       250        260        270        280        290        300        310        320        330        340        350        360

W  P  T  F  A  E  K  A  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAAACTTTTACAGAAGGACAAGGTTGCAGTAATTTTCGGCGCTTGGACCTCGGCAAGTCGCAAAGCCGTACTCCCAGTCGTCGAAGAAATAA
GACCGGCTGAAGCGACTTTTCCGATTCTTTGAAAATGTCTTCCTGTTCCAACCGTCATTAAAAGCCGCGAACCTGGAGCCGTTCGGCATGAGCGTCAGCAGCTTCTTTTATT
       370        380        390        400        410        420        430        440        450        460        470        480

G  L  L  F  Y  P  V  Q  Y  E  G  L  E  S  S  P  N  I  F  Y  M  G  A  A  P  N  Q  Q  I  V  P  A  V  K  W  L  F  D  N  G
TGGGCTTCTCTTCTATCCGGTTCAGTATGAAGGTCTCGAAAGTTCCCCAAATATCTTTTACATGGGCGCCGCCCCAAACCAGCAGATCGTGCCAGCAGTTAAATGGCTCTTCGACAACGG
ACCCGAAGAGAAGATAGGCCAAGTCATACTTCCAGAGCTTTCAAGGGGTTTATAGAAAATGTACCCGCGGCGGGGTTTGCTGCTAGCACGTCGTCAATTTACCGAGAAGCTGTTGCC
       490        500        510        520        530        540        550        560        570        580        590        600

K  K  R  F  Y  L  L  G  S  D  A  V  F  P  R  T  A  N  K  I  H  K  A  Y  L  K  Y  L  G  G  V  V  V  G  E  E  Y  T  P  C
TAAGAAGCGGTTCTACCTCTTGGGCTCCGATGCGGTATTCCCACGCACAGCAGACAAACAAGATTATTAAGGCATACCTCAAATACCTCGGCGGTGTTGTAGTAGTGAAGAATACACCCCATG
ATTCTTCGCAAAGATGAGAACCCGAGCCTACGCCATAAGGGAGTACGCCATAAGGGTGCGTGTCGTTTGTTCTAATAATTCCGTATGGAGTTATGAGCCGCCACAACATCATCCACTTCTATGTGGGGTAC
       610        620        630        640        650        660        670        680        690        700        710        720

G  H  T  D  Y  S  S  V  I  N  K  I  K  A  A  K  P  D  V  V  F  N  T  L  N  G  D  S  N  V  A  F  F  K  Q  L  K  D  A  G
TGGTCACACTGACTATAGTTCTGTCATTAATAAAATCAAAGCCGCAAAGCCGGATGTCGTATTTAACACTCTGAACGGGGATAGTAATGTAGCCTTTTTCAAGCAATTAAAGGATGCCGG
ACCAGTGTGACTGATATCAAGACAGTAATTATTTTAGTTTCGGCGTTTCGGACTACATGATCAATTACACATCGGAAAAAGTTCGTTAATTTCCTACGGCC
       730        740        750        760        770        780        790        800        810        820        830        840

I  D  A  N  T  L  P  V  M  S  V  S  I  A  E  E  E  I  K  G  I  G  P  E  Y  L  K  G  H  L  V  T  W  N  Y  F  Q  S  V  D
GATTGACGCAAATACACTCCCTGTCATGAGCGTGTCATCGCCGAGGAGATCAAAGGCATTGGTCCAGAGTATTTAAAAGGTCATCTGGTCACATGGAACTATTTCCAAAGTGTAGA
CTAACTGCGTTTATGTGAGGGACAGTACTCCGCACTCGCTAGCGGCTCCTCCTCTAGTTTCCGTAACCAGTCTCATAAATTTCCAGTAGACCAGTTGATACCTTGATAAAGGTTTCACATCT
       850        860        870        880        890        900        910        920        930        940        950        960
```

```
                    270                         280                         290                         300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAACAAGGAGTTCGTTGAGAAGTATAAGAAAAAGTATGGGGAGGACCGGGTGACAGATGACCCAATCGAGGCGGCATAACATCGGCGTATACTTATGGGCTAAAGCGGTTGA
ATGTGGCCTTTGTTCCTCAAGCAACTCTTTATATTCTTTTCATATCCCTCCTGGCCCCACTGTCTACTGGGTTAGCTCCGCATATGAATACCCGATTTCGCCAACT
      970        980        990        1000       1010       1020       1030       1040       1050       1060       1070       1080
              310                         320                         330                         340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAAGGGCATCGAATTTAACGCCCAGTAAAGATTGACGGCGACAACCAGCACCTCTACAAGACGGTGCG
CTTCCGCCCCAGCTGTCTGCACCTATTCCAGGCGCCTCCGGCGCTTCCCGTAGCTTAAATTGCGGGTCTCATTTCTAACTGCCGCTGTTGGTCGTGGAGATGTTCTGCCACGC
      1090       1100       1110       1120       1130       1140       1150       1160       1170       1180       1190       1200
              350                         360                         370                         380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTGCCAGTTAAGCACTCAACACCTTTTGTTTATTTGTCTAGTATAAATTTCCAATACTTACCCGTGTCCCCAATTCGCTCGTTCCACC
      1210       1220       1230       1240       1250       1260       1270       1280       1290       1300       1310       1320
              390
S  H  H  H  H  H  *  *
TTCACATCATCATCATCATTAATGAAAGGGCGATATCCAGCACACTGGCGCCGTTACTAGTGGATCCGGCTGCTAACAAAGCCCGAAAGGAAGCTGAGTTGCTGCTGCCACCGCT
AAGTGTAGTAGTAGTAGTAGTAATTACTTTCCCGCTATAGGTCGTGTGACCCTAGGCCGACGATTGTTTCGGGCTTTCCTTCGACTCAACCGACGACGGTGGCGA
      1330       1340       1350       1360       1370       1380       1390       1400       1410       1420       1430       1440

GAGCAATAACTAGCATAACCCCTTGGGCCTCTAAACGGGTCTTTTTTGCTGAAAGAGGAACTATATCCGGAGGCGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGCTGCAAC
      1450       1460       1470       1480       1490       1500       1510       1520       1530       1540
```

FIG. 72 (Continued)

FIG. 73 - Exemplary Expression Construct for csUBP7_18GC.14

```
CGCTTGGGACTGCCATAGCTGGCCCGGTGATGCCGCCACGATGCTCGGCGCTGTAGAGGATCGAGATCTCGATCCCGCGAAATTAATACAGACTCACTATAGGGAGACCACAACGGTTTC
GCGAACCCTGATCCGACCGGGCCACCTACGGCCGTGCTACGCAGCCGCATCCTAGCTCCTAGCTCCATCCTAGCTCCTAGAGGCGCTTAATTATGCTGAGTGATATCCCTCGTGTTGCCAAAG
         10        20        30        40        50        60        70        80        90       100       110       120

CCTCTAGAAATAATTTGTTAACTTTAAGAAGGAGATATACCATGAGTTCATCAGAGAATCAGAAAAAAGAAGAGACCATCAAAGTAGGGATTCTCCACAGCTTGAGTGGTAC
GGAGATCTTTATTAAACAATTGAAATTCTTCCTCTATATGGTACTCAAGTAGTCTTAGTCTTTTTCTTTTACTTCTCTGGTAGTTCATCCTAAGAGTGTCGAACTCACCATG
                                               M   S   S   S   E   K   S   E   E   T   I   K   V   G   I   L   H   S   L   G   T
                                                                                10                      20
        130       140       150       160       170       180       190       200       210       220       230       240

GATGTCAATCTCAGAGAGTTCCTTAAAGATGCCGAATTCATGGCCATCGAAGAGATCAACAATAATGGCGGTGTGTTAGGTAAAAAGTTAGAACCGATCGTGGAAGATGGCGCCTCAGA
CTACAGTTAGAGTCTCTCAAGGAATTTCTACGGCTTAAGTACCGGTAGCTTCTACGTTGTTATTACCGCCACACAATCCATTTTTCAATCTTGGCTAGCACCTTCTACCGCGGAGTCT
   M   S   I   S   E   V   S   L   K   D   A   E   L   M   A   I   E   E   I   N   N   N   G   G   V   L   G   K   K   L   E   P   I   V   E   D   G   A   S   D
               30                      40                      50                      60
        250       260       270       280       290       300       310       320       330       340       350       360

CTGGCCGACCTTCGCTGAAAAGGCTAAGAAACTTTTACAGAAGGACAAGGTTGGCAGTAATTTTCGGCGCTTGACCTCGGCAAGTCGCAAAGCCGTTCAGCGTTCAGCCAGCTGAGGTCAGCAGCTTCTTTTATT
GACCGGCTGAAGCGACTTTTCCGATTCGTTTTGAAAATGTCTTCCTGTTCCACCGTCATTAAAAGCCGCGAACTGGAGCCGTTCAGCGTTCAGCGTCGAGTCTCGGACTCGGTCGACTCCAGTCGTCGAAGAAATAA
   W   P   T   F   A   E   K   A   K   K   L   L   Q   K   D   K   V   A   V   I   F   G   A   W   T   S   A   S   R   K   A   V   L   P   V   V   E   E   N   N
           70                      80                      90                     100
        370       380       390       400       410       420       430       440       450       460       470       480

TGGGCTTCTCTCTATCCGGTTCAGTGAAGAAGGCTCGAAAGTTCCCCAAATATCTTTACATGGGCGCCGCCCCAAACCAGCAGATCGTGCCAGCAGTTAAATGGCTCTTCGACAACGG
ACCCGAAGAGAAGATAGGCCAAGTCACATGTCATACTTCAAGGGGTTTAGAAATGTACCGCGGCCGGGGTTTGCTGCTCTAGCGACGGTCGTCAATTTACCGAGAAGCTGTTGCC
   G   L   L   F   Y   P   V   Q   Y   E   G   L   E   S   S   P   N   I   F   Y   M   G   A   A   P   N   Q   Q   I   V   P   A   V   K   W   L   F   D   N   G
                          110                     120                     130                     140
        490       500       510       520       530       540       550       560       570       580       590       600

TAAGAAGCGTTTCTACCTCTTGGGCTCCGATTATGTAGCGCCACGCGTGCCAGCCATACCTCAAATAAGGCATACCTCAAATAATTAAGGCATACCTCAAATACCACCCATG
ATTCTTCGCAAAGATGGAGAACCCGAGCCTAATACATCGCGGTGCGTCGTTGTTCATCGTGTGAGGTTGTTATCGACGCCACAACATCATCCACTTCTATGTGGGGTAC
   K   K   R   F   Y   L   L   G   S   D   Y   V   A   P   R   T   A   N   K   I   I   K   A   Y   L   K   Y   L   G   G   V   V   V   G   E   E   Y   T   P   C
                         150                     160                     170                     180
        610       620       630       640       650       660       670       680       690       700       710       720

TGGTCACACTGACTATAGTTCTGTCATTAATAAATCAAAGCCGCAAAGCCAGACGTCGTATTTAACACTCTGAACGGGATAGTAGCCTTTTTCAAGCAATTAAAGGATGCCGG
ACCAGTGTGACTGATATCAAGACAGTACTAATTATTATTTAGTTTGCGGCGTTTCGGCGTTCTGCAGCATAAAAGTTGTGAGTACTTGCGAAAAAGTTCGTTAATTCCTACGGCC
   G   H   T   D   Y   S   S   V   I   N   K   I   K   A   A   K   P   D   V   V   F   N   T   L   N   G   D   S   N   V   A   F   F   K   Q   L   K   D   A   G
                         190                     200                     210                     220
        730       740       750       760       770       780       790       800       810       820       830       840

ATTGACGCAAATACACTCCCTGTCATGAGCGTGAGCATCGCCGAGGAGATCAAAGGCATTGGTCCAGAGTATTTAAAAGGTCATCTGGTCACATGTACCCAGTGAACTATTCCAAAGTGTAGA
CTAACTGCGTTTATGTGAGGGACAGTACTCGCACTCGTAGCGGCCTCCTCTAGTTTCCGTAACCAGGTCTCATAAATTTCCAGTAGACCGTCACCGTCAGTCACACCAGTGTGTTCAAGTTCAATCT
   I   D   A   N   T   L   P   V   M   S   V   S   I   A   E   E   I   K   G   I   G   P   E   Y   L   K   G   H   L   V   T   W   N   Y   F   Q   S   V   D
                         230                     240                     250                     260
        850       860       870       880       890       900       910       920       930       940       950       960
```

```
        270                         280                        290                         300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAAACAAGGAGTTCGTTGAGAAGTATAAGAAAAAGTATGGGGAGGACCGGGTGACAGATGACCAATCGAGGCGGCATAACATCGGCGTATACTTATGGGCTAAAGCGGTTGA
ATGTGGCCTTTGTTCCTCAAGCAACTCTTTATATTCTTTTCATACCCCTCCTGGCCACACTGTCTACTGGGTTAGCTCCGCGTATGTAGCCGCATATGAATACCCGATTTCGCCAACT
    970       980        990       1000       1010      1020       1030      1040       1050      1060      1070      1080

310                        320                          330                          340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCAGAGGGCCCAGTAAAGATTGACGGCGACAACCAGCACCCTCTACAAGACGGTGCG
CTTCCGCCCCAGCTGTCTGCACAGCTATTCCAGGCCCTCCGGCGCTTCCCGGGTCTCATTTCGAGTTAAATTGCGGGTCTTAACTGCCGCTGTTGGTCGTGGAGATGTTCTGCCACGC
    1090      1100       1110      1120       1130      1140       1150       1160      1170      1180       1190      1200

350                         360                         370                          380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTGCCAGTTTAAGCACTCAACACCTTTGTTATTTGGTCTGTAGGGTATAAATTTCCAATACTTACCCGTGTCCCCAATTCGCTCGTTCCACC
    1210      1220       1230      1240       1250       1260      1270      1280      1290        1300      1310      1320

390
S  H  H  H  H  H  *  *
TTCACATCATCATCATCATCATTAATGAAAGGGCGATATCCAGCACTGGGCGTCTGCTCTACTAGTGGATCGGATCGGCTCGTAACAAAGCCCGAAAGGAAGCTGAGTTGGCTGCTGCCACCGCT
AAGTGTAGTAGTAGTAGTAGTAATTACTTTCCCGCTATAGGTCGTGTGACCGCCAATGATCAACCTAGGCCGGACGATTGTTTCGGGCTTTCCTTCGACTCAACCGACGACGGTGCCGA
    1330      1340       1350      1360       1370      1380       1390      1400       1410      1420      1430       1440

GAGCAATAACTAGCATAACCCCTTGGGCCTCTAAACGGGTCTTGAGGGGTTTTTTGCTGAAAGAGGAACTATATCCGGAGCGGACTCCCACGGCACGTTG
CTCGTTATTGATCGTATTGGGGAACCCCGAGAATTGCCCAGAACTCCCAAAAAAACGACTTTCCTCCTTGATATAGGCCTCGCTGAGGGTGCCGTGCAAC
     1450      1460       1470      1480       1490       1500       1510       1520      1530       1540
```

FIG. 73 (Continued)

FIG. 74 - Exemplary Expression Construct for csUBP7_18GC.15

```
CGCTTGGGACTGCCATAGCCTGGCCCGGTGATGCCGGCCACGATGCTCCGGCGTAGAGGATCGAGATCTCGATCCCGCGAAATTAATACGACTCACTATAGGGAGACCACAACGGTTTC
GCGAACCCTGATCCGACCGGGCCACTACGGCCGTGCTACCAGGCCATCCTAGCTCCTAGCTCGGGCGCTTTAATTATGCTGAGTGATATCCCTCGTGTTGCCAAAG
         10        20        30        40        50        60        70        80        90       100       110       120

M  S  S  S  E  K  E  K  S  E  E  T  I  K  V  G  I  L  H  S  L  G  T
CCTCTAGAAATAATTTGTGTTAACTTTAAGAAGGAGATATACCATGAGTTCATCAGAGAATCAGAAAAAGAAAAAGAAGAGACCATCAAAGTAGGGATTCTCCACAGCTTGAGTGGTAC
GGAGATCTTATTAAAACAATTGAAATTCTTCCTCTATATGGTACTCAAGTAGTCTTAGTCTTTTCTTTTTCTTTTCTTCTCTGGTAGTTCATCCCTAAGAGAGTGTCGAACTCACCATG
        130       140       150       160       170       180       190       200       210       220       230       240

M  S  I  S  E  V  S  L  K  D  A  E  L  M  A  I  E  E  I  N  N  N  G  V  L  G  K  K  L  E  P  I  V  E  D  G  A  S  D
GATGTCAATCTCAGAGTTTCCTTAAAGATGCCGAATTAATGGCCATCGAAGAGATCAACAACAATGGCGGTGTGTTAGGTAAAAAGTTAGAACCGATCGTGGAAGATGGCGCCTCAGA
CTACAGTTAGAGTCTCAAAGGAATTTCTACGGCTTAATTACCGGTAGCTTCTTCTAGTTGTTATTACCGCCACACAATCCATTTTTCAATCTTGGCTAGCACCTTCTACCGCGGAGTCT
        250       260       270       280       290       300       310       320       330       340       350       360

W  P  T  F  A  E  K  A  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAAACTTTTACAGAAGGACAAAGTTTCGGCCGCTTGACCTCCAGTCGCCAAAGCCGAACCTCGCAAGTCGCTACTCCAGTCGTCGAAGAAATAA
GACCGGCTGGAAGCGACTTTTCCGATTCTTTGAAAATGTCTTCCTGTTCCAAAATGTCTTCCTGCGAACTGGAACCTGGACGGCGTTCAGCGTTCGGCATGAGAGGTCAGCAGCTTCTTTATT
        370       380       390       400       410       420       430       440       450       460       470       480

G  L  L  F  Y  P  A  Q  Y  E  G  L  E  S  S  P  N  I  F  Y  M  G  A  A  P  N  Q  Q  I  V  P  A  V  K  W  L  F  D  N  G
TGGGCTTCTCTTCTATCCGGCGCAGTAGTGAAGGTCTCGAAAGTTCCCAAATATCTTTACATGGGCGCCGCCCCAAACCAGCAGATCGTGCCAGCAGTTAAATGGCTCTTCGACAACGG
ACCCGAAGAGAAGATAGGCCGCGTCATCACTTCCAGAGCTTTCAAGAGGCTTTATAGAAATGTACCCGCGGCGGTTTGGTCGTCTAGCACGGTCGTCAATTTACCGAGAAGCTGTTGCC
        490       500       510       520       530       540       550       560       570       580       590       600

K  K  R  F  Y  L  L  G  S  D  Y  Y  F  P  R  T  A  N  K  I  H  K  A  Y  L  K  Y  L  G  G  V  V  V  G  E  E  Y  T  P  C
TAAGAAGCGTTTCTACCTCTTGGGCTCGGATTATGTATTCCCACGCACAGCACAAACAAGATTATTAAGGCATACCTCAAATACCTCGGCGTGTTGTAGTAGTGAAGAATACACCCATG
ATTCTTCGCAAAGATGGAGAATGGAGAACCCGAGCCTAATACATATAAGGGTGCGTGTCGTTGTTGCTAATAATTCCGTATGAGTTTATGAGCCGCCACAACATCACCACTTCTTATGTGGGGTAC
        610       620       630       640       650       660       670       680       690       700       710       720

G  H  T  D  Y  S  S  V  I  N  K  I  K  A  A  K  P  D  V  V  F  N  T  L  N  G  D  S  N  V  A  F  F  K  Q  L  K  D  A  G
TGGTCACACTGACTATAGTTCTGTCATTAATAAAATCAAAGCCGCAAAGCCGGATGTCGTATTTAACACTCTGAACGGGGATAGTAATGCCTTTTTCAAGCAATTAAAGGATGCCGG
ACCAGTGTGACTGATATCAAGACAGTAGTTATTTTAGTTTCGGCGTTTCGGCGTTTCGGCTACAGCATAAATTGTGAGACTTGCCCCTATCATTACATCGGAAAAGATCGTTAATTCCTACGGCC
        730       740       750       760       770       780       790       800       810       820       830       840

I  D  A  N  T  L  P  V  M  S  V  S  I  A  E  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGATCAAAGGCATTGGTCCAGAGTATTTAAAAGGTCATCTGGTCACATGAACTATTTCCAAAGTGTAGA
CTAACTGCGTTATGTGAGGACAGTACTCGCACTCCGTAGCGGCTCCTCCTAGTTTCCGTAACCATCCTCATAAATTTCCAGTAGACCAGTGGTCATTGAATACCTGTGATAAAGGTTCACATCT
        850       860       870       880       890       900       910       920       930       940       950       960
```

```
      270                    280                    290                    300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAAACAAGGAGTTCGTTGAAGAAAAGTATAAGAAAAAGTATGGGGAGGACCGGGTGACAGATGACCAATCGAGGCGGCATAACATCGGCGTATACTTATGGGCTAAAGCGGTTGA
ATGTGGCCTTTGTTCCTCAAGCAACTCTTTATATTCTTTTCATATCCCCTCCTGGCCCACTGTCTACTGGGTTAGCTCCGCCGTATGTAGCCGCATATGAATACCCGATTTCGCCAACT
    970       980       990      1000      1010      1020      1030      1040      1050      1060      1070      1080

310                    320                    330                    340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAAGGGCATCGAATTTAACGCCCCAGAGGGCCCAGTAAAGATTGACGGCGACAACCAGCACCTCTACAAGACGGTGCG
CTTCCGCCCCCAGCTGTCTGCACCTATTCCAGGCGCCTCCCGGCGCCTTCCCGGGTCTCCCGGGTCAATTCTAACTGCCGCTGTTGGTCGTGGAGATGTTCTGCCACGC
   1090      1100      1110      1120      1130      1140      1150      1160      1170      1180      1190      1200

350                    360                    370                    380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTTAAGCACTCAACACCTTTTGTTTATTTGGTCTAGTGATATAAATTTTCCAATACTTACCCGTGTCCCCAATTCGCTCGTTCCACC
   1210      1220      1230      1240      1250      1260      1270      1280      1290      1300      1310      1320

390
S  H  H  H  H  H  *  *
TTCACATCATCATCATCATTAATGAAAGGGCGATATCCAGCACACTGGGCGTGCTAACAAGCCCGAAAGGAAGCTGAGTTGGCTGCTGCCACCGCT
AAGTGTAGTAGTAGTAGTAGTAATTACTTTCCCGCTATAGGTCGTGTGACCGCCAATGATCACCTAGCCGACGATTGTTCGGGCTTTCCTTCGACTCAACCGACGACGGTGCCGA
   1330      1340      1350      1360      1370      1380      1390      1400      1410      1420      1430      1440

GAGCAATAACTAGCATAACCCCTTGGGGCCTCTAAACGGGTCTTTTTGCTGAAAGGAGGAACTATATCCGGAGCGGACTCCCACGGCACGTTG
CTCGTTATTGATCGTATTGGGGAACCCCGAGATTGCCCAGAAACGACTTTCCTCCTTGATATAGGCCTCGCTGAGGGTGCCGTGCAAC
   1450      1460      1470      1480      1490      1500      1510      1520      1530      1540
```

FIG. 74 (Continued)

FIG. 75 - Exemplary Expression Construct for csUBP7_18GC.16

```
                            270                          280                          290                         300
         T  P  E  N  K  E  F  V  E  K  Y  K  K  K  Y  G  E  D  R  V  T  D  D  P  I  E  A  A  Y  I  G  V  Y  L  W  A  K  A  V  E
         TACACCGGAAAACAAGGAGTTCGTTGAGAAGTATAAGAAAAAGTATGGGGAGGACCGGGTGACAGATGACCAATCGAGGCGGCATACATCGGCGTATACTTATGGCTAAAGCGGTTGA
         ATGTGGCCTTTTGTTCCTCAAGCAACTCTTTATATTCTTTTCATAGCCACCCCTCCTGGCCCACTGTCTACTGGGTTAGCTCCGCCGTATGTAGCCGCATATGAATACCCGATTTCGCCAACT
                 980            990           1000           1010          1020          1030          1040          1050          1060          1070          1080
           310                          320                          330                         340
         K  A  G  S  T  D  V  D  K  V  R  E  A  A  K  G  I  E  F  N  A  P  E  G  P  V  K  I  D  G  D  N  Q  H  L  Y  K  T  V  R
         GAAGGCGGGGTCGACAGACGTGGATAAGGTCCGGGAGGCCGCGAAGGGCATCGAATTTAACGCCCCAGAGGGCCCAGTAAAGATTGACGGCGACAACCAGCACCTCTACAAGACGGTGCG
         CTTCCGCCCCAGCTGTCTGCACCTATTCCAGGCCCTCTGCACCTAGCTTAAATTGCGGGGTCTCCCGGGTCATTTCTAACTGCCGCTGTTGGTCGTGGAGATGTTCTGCCACGC
                1090           1100          1110          1120          1130          1140          1150          1160          1170          1180          1190         1200
           350                          360                         370                          380
         I  G  E  I  L  E  N  G  Q  I  R  E  L  W  K  T  N  K  P  V  K  P  D  P  Y  L  K  G  Y  E  W  A  Q  G  L  S  E  Q  G  G
         TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
         ATAACCACTCTAGGACCTCTTGCCAGTTTAAGCACTCAACACTTTGTTATTTGGTCAAACACCTTTTGTCTAGTGATATAAATTTCCAATACTACCCGTCCCAATTCGCTCGTTCCACC
                1210           1220          1230          1240          1250          1260          1270          1280          1290          1300          1310         1320
           390
         S  H  H  H  H  H  *  *
         TTCACATCATCATCATCATCATTAATGAAAGGGCGATATCCAGCACACTGGCGTCCGGCCTGCTAACAAGCCCGAAAGGAAGCTGAGTTGGCTGCTGCCACCGCT
         AAGTGTAGTAGTAGTAGTAGTAATTACTTCCCGCTATAGGTCGTGTGACCGCCAATGATCACCTAGGCCGACGATTGTTCGGGCTTTCCTTCGACTCAACCGACGACGGTGGCGA
                1330           1340          1350          1360          1370          1380          1390          1400          1410          1420          1430         1440

GAGCAATAACTAGCATAACCCCTTGGGCCTCTAAACGGGTCTTTGAGGGGTTTTTTTGCTGAAAGGAGGAACTATATCCGGAGGCGGACTCCCACGGCACGTTG
         CTCGTTATTGATCGTATTGGGGAACCCCGAGAATTGCCCAGAACTCCCAAAAAACGACTTTCCTCCTTGATATAGGCCTCGCTGAGGGTGCCGCGTGCAAC
               1450           1460          1470          1480          1490          1500          1510          1520          1530          1540
```

FIG. 75 (Continued)

FIG. 76 – Exemplary Expression Construct for csUBP7_18GC.17

```
     270                      280                         290                             300
T  P  E  N  K  E  F  V  E  K  Y  K  K  K  Y  G  E  D  R  V  T  D  D  P  I  E  A  A  Y  I  G  V  V  Y  L  W  A  K  A  V  E
TACACCGGAAAACAAGGAGTTCGTTGAGAAGTATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTCATACCCCTCCTGGGTTAGCTCCGCGTATGTAGCCGCATATGAATACCCGATTTCGCCAACT
        970         980         990        1000        1010        1020        1030        1040        1050        1060        1070        1080
     310                320                                330                                    340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCAGTAAAGATTGACGGCGACAACCAGCACCTCTACAAGACGGTGCG
CTTCCGCCCCAGCTGTCTGCACCTATTCCAGGCGCTTCCCGGGTCTCCCGGTTCATTTCTAAATTGCGGGTAAGCTTAAACTGCCGCTGTTGGTCGTGGAGATGTTCTGCCACGC
         1090        1100        1110        1120        1130        1140        1150        1160        1170        1180        1190        1200
     350                        360                                370                                 380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTTAAGCACTCAACACCTTTTGTTTATTTGGTCTAGTGATATAAATTTCCAATACTTACCCGTGTCCCCAATTCGCTCGTTCCACC
       1210         1220        1230        1240        1250        1260        1270        1280        1290        1300        1310        1320
     390
S  H  H  H  H  H  *  *
TTCACATCATCATCATCATCATTAATGAAAGGGCGATATCCAGCACACTGGGCGCCGTTACTAGTGGATCGGCTGCTAACAAAGCCCGAAAGGAAGCTGAGTTGCTGCTGCCACCGCT
AAGTGTAGTAGTAGTAGTAGTAATTACTTTCCCGGCTATAGGTCGTGTGACCGCCAATGATCACCTAGCCGACGATTGTTTCGGGCTTTCCTTGACTCAACCGACGACGGTGCCGA
        1330        1340        1350        1360        1370        1380        1390        1400        1410        1420        1430        1440

GAGCAATAACTAGCATAACCCCTTGGGCCTCTAAACGGGTCTTTGAGGGGTTTTTTGCTGAAAGGAGGAACTATATCCGGAGGCGACTCCCACGGCACGTTG
CTCGTTATTGATCGTATTGGGGAACCCCGAGATTGCCCAGAAACGACTTTCCTCCTTGATATAGGCCTCGCTGAGGGTGCCGTGCAAC
   1450        1460        1470        1480        1490        1500        1510        1520        1530        1540
```

FIG. 76 (Continued)

FIG. 77 - Exemplary Expression Construct for csUBP7_18GC.18

```
CGCTTGGGACTGCCATAGCTGGCCCGGTGATGCCGGCCACGATGCGTCGATCGAGATCTCGATCCCGCGTAGAGATAATCGAGATCTCACTACAGACTCACTATAGGGAGACAATTAATACAGACTCACTATAGGGAGAACACAACGGTTTC
                10        20        30        40        50        60        70        80        90       100       110       120
GCGAACCCTGATCCGACGGTATCCGACGGGCCACTACGGCCGGTGCTACCAGGCCATCCTAGCTGTCACAGTCTCCTAGCTTCCTAGCTAGGGCGCTTTAATTATGCTGAGTGATATCCCTCGTGTTGCCAAAG

CCTCTAGAAATAATTTTGTTTAACTTTAAGAAGGAGATATACCATGAGTTCATCAGAATCAGAAAAAGTGAAGACCATCAAAGTAGGAGATCCTCCACAGCTTGAGTGGTAC
               130       140       150       160       170       180       190       200       210       220       230       240
                                  M  S  S  S  E  K  S  E  E  T  I  K  V  G  I  L  H  S  L  S  G  T
                                                                              10                  20
GAGAGATCTTATTAAAACAAATTGAAATTCTTCCTCATAGAGTACTTCAAGTAGTCTTAGTCTTTTCTTTTTCACTTCTCTGGTAGTTTCATCCTAAGACGTGTCGAACTCACCATG
```

(sequence continues with further numbered rows and translated protein sequence below)

```
          270                    280                   290                      300
T P E N K E F V E K Y K K Y G E D R V T D D P I E A A Y I G V Y L W A K A V E
TACACCGGAAAACAAGGAGTTCGTTGAGAATATAAGAAAAAGTATGGGGAGGACCGGGTGACAGATGACCCAATCGAGGCGGCATAACATCGGCGTATACTTATGGGCTAAAGCGGTTGA
ATGTGGCCTTTGTTCCTCAAGCAACTCTTTATATTCTTTTCATAGCCCCTCCTGGCCACCTGTCTACTGGGTTAGCTCCGCCGTATGTAGCCGCATATGAATACCCGATTTCGCCAACT
     970         980         990        1000        1010        1020        1030        1040        1050        1060        1070        1080
      310                    320                    330                       340
K A G S T D V D K V R E A A K G I E F N A P E G P V K I D G D N Q H L Y K T V R
GAAGGCGGGGTCGACAGACGTGGATAAGGTCCGGGAGGCCATCGAATTTAACGCCCAGAGGGCCCAGTAAAGATTGACGGCGACAACCAGCACCTCTACAAGACGGTGCG
CTTCCGCCCCAGCTGTCTGCACCTATTCCAGGCCCTCCCGGCGCTTCCCGGAGCTTAAATTGCGGGGTCTCATTTCTAACTGCCGCTGTTGGTCGTGGAGATGTTCTGCCACGC
    1090        1100        1110        1120        1130        1140        1150        1160        1170        1180        1190        1200
      350                    360                     370                    380
I G E I L E N G Q I R E L W K T N K P V K P D P Y L K G Y E W A Q G L S E Q G G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTTAAGCACTCAACACCTTTGTTATTTGTCTAGTGATCAATACTTACCCCGTGTCCCCAATTCGCTCGTTCCACC
    1210        1220        1230        1240        1250        1260        1270        1280        1290        1300        1310        1320
      390
S H H H H H H * *
TTCACATCATCATCATCATCATTAATGAAAGGGCGATATCCAGCACACTGGGCGTGCGGCTGCTACTAGTGGATCCGGCTCTAACAAAGCCCGAAAGGAAGCTGAGTTGCTGCTCCACCGCT
AAGTGTAGTAGTAGTAGTAGTAATTACTTTCCCGCTATAGGTCGTGTGACCGCCAATGATCACCTAGGCCGACGATTGTTTCGGGCTTTCCTTGACTCAACCGACGACGGTGCCGA
    1330        1340        1350        1360        1370        1380        1390        1400        1410        1420        1430        1440

GAGCAATAACTAGCATAACCCCTTGGGCCTCTAAACGGGTCTTTTTTGCTGAAAGAGGAACTATATCCGGAGGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGTGCAAC
    1450        1460        1470        1480        1490        1500        1510        1520        1530        1540
```

FIG. 77 (Continued)

FIG. 78 - Exemplary Expression Construct for csUBP7_18GC.19

```
      270                280                290               300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAGAAACAAGGAGTTCGTTGAGAAGTATAAGAAAAAGTATGGGGAGGACCGGGTGACAGATGACCCAATCGAGGCGGCATACATCGGCGTATACTTATGGGCTAAAGCGGTTGA
ATGTGGCCTTTGTTCCTCAAGCAACTCTTTTATATTCTTTTCATACCCCTCCTGGCCCACTGTCTACTGGGTTAGCTCCGCCGTATGTAGCCGCATATGAATACCCGATTTCGCCAACT
     970       980       990      1000      1010      1020      1030      1040      1050      1060      1070      1080

310                320                330               340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCCAGAGGGTCCCAGTAAAGATTGACGGCGACAACCAGCACCTCTACAAGACGGTGCG
CTTCCGCCCCAGCTGTCTGCACCTATTCCAGGCCCTCCGGCGCTTCCCGTAGCTTAAATTGCGGGGTCTCATTTCTAACTGCCGCTGTTGGTCGTGGAGATGTTCTGCCACGC
    1090      1100      1110      1120      1130      1140      1150      1160      1170      1180      1190      1200

350                360                370               380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
ATAACCACTCTAGGACCTCTTGCCATTCAAGCACTCAACACCTTTTGTTATTTGGTCTAGTATATAAATTTTCCAATACTTACCCGTGTCCCCAATTCGCTCGTTCCACC
    1210      1220      1230      1240      1250      1260      1270      1280      1290      1300      1310      1320

390
S  H  H  H  H  H  *  *
TTCACATCATCATCATCATCATTAATGAAAGGGCGATATCCAGCACACTGGCCGTTACTAGTGGATCCGGCTGCTAACAAAGCCCGAAAGGAAGCTGAGTTGGCTGCTGCCACCGCT
AAGTGTAGTAGTAGTAGTAGTAATTACTTTCCCGCTATAGGTCGTGTGACCGGCAATGATCACCTAGCCGACGATTGTTTCGGGCTTTCCTTCGACTCAACCGACGACGGTGGCGA
    1330      1340      1350      1360      1370      1380      1390      1400      1410      1420      1430      1440

GAGCAATAACTAGCATAACCCCTTGGGGCCTCTAAACGGGTCTTGAGGGGTTTTTTTGCTGAAAGAGGAACTATATCCGGAGGCGACTCCCACGGCACGTTG
CTCGTTATTGATCGTATTGGGGAACCCCGGAGATTTGCCCAGAAACTCCCAAAAAAACGACTTTCCTCCTTGATATAGGCCTCGCTGAGGGTGCCGCGTGCAAC
    1450      1460      1470      1480      1490      1500      1510      1520      1530      1540
```

FIG. 78 (Continued)

FIG. 79 - Exemplary Expression Construct for csUBP7_18GC.20

```
          270                         280                         290                         300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAAACAAGGAGTTCGTTGAGAAATATAAGAAAAAGTATGGGGAGGACCGGGTGACAGATGACCAATCGAGGCGGCATAACATCGGCGTATACTTATGGGCTAAAGCGGTTGA
ATGTGGCCTTTGTTCCTCAAGCAACTCTTTATATTCTTTTTCATATCCCTCCTGGCCACTGTCTACTGGGTTAGCTCCGCCGTATGTAGCCGCATATGAATACCCGATTTCGCCAACT
    970         980         990         1000        1010        1020        1030        1040        1050        1060        1070        1080

310                         320                         330                         340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCCAGAGGGCCCAGTAAAGATTGACGGCGACAACCAGCACCTCTACAAGACGGTGCG
CTTCCGCCCCAGCTGTCTGCACCTATTCCAGGCCCTCCGGCGCTTCCCGTAGCTTAAATTGCGGGGTCTCATTTCTAACTGCCGCTGTTGGTCGTGGAGATGTTCTGCCACGC
    1090        1100        1110        1120        1130        1140        1150        1160        1170        1180        1190        1200

350                         360                         370                         380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTGCCAGTTAAGCACTCAACACCTTTGTTTATTTGTCTAGGTATAAATTTTCCAATACTTACCCGTGTCCCCAATTGCCTCGTTCCACC
    1210        1220        1230        1240        1250        1260        1270        1280        1290        1300        1310        1320

390
S  H  H  H  H  H  *  *
TTCACATCATCATCATCATCATTAATGAAAGGGCGATATCCAGCACTGGGCCGTTACTAGTGGATCGGATCCGGCTGCTAACAAAGCCCGAAAGGAAGCTGAGTTGGCTGCTGCCACCGCT
AAGTGTAGTAGTAGTAGTAGTAATTACTTTCCCGCTATAGGTCGTGTGACCCGGCCAATGATCACCTAGGCCGACGATTGTTTCGGGCTTTCCTTCGACTCAACCGACGACGGTGCCGA
    1330        1340        1350        1360        1370        1380        1390        1400        1410        1420        1430        1440

GAGCAATAACTAGCATAACCCCTTGGGCCTCTAAACGGGTCTTGAGGGGTTTTTTGCTGAAAGAGGAACTATATCCGGAGGCGACTCCCACGGCACGTTG
CTCGTTATTGATCGTATTGGGGAACCCCGAGAATTGCCCAGAAACTCCCAAAAAACGACTTTCCTCCTTGATATAGGCCTCGCTGAGGGTGCCGTGCAAC
    1450        1460        1470        1480        1490        1500        1510        1520        1530        1540
```

FIG. 79 (Continued)

FIG. 80 - Exemplary Expression Construct for csUBP7_18GC.21

```
      270                    280                        290                           300
  T P E N K E F V E K Y K K K Y G E D R V T D D P I E A A Y I G V Y L W A K A V E
TACACCGGAAAACAAGGAGTTCGTTGAGAAGTATAAGAAAAAGTATGGGGAGGACCGGGTGACAGATGACCCAATCGAGGCGGCATAACATCGGCGTATACTTATGGGCTAAAGCGGTTGA
ATGTGGCCTTTGTTCCTCAAGCAACTCTTTATATTCTTTTCATACCCCTCCTGGCCACCCTCTGGGTTAGCTCCGCCATATGAATACCCGATTTCGCCAACT
    970        980        990       1000       1010       1020       1030       1040       1050       1060       1070       1080
     310                    320                        330                           340
  K A G S T D V D K V R E A A K G I E F N A P E G P V K I D G D N Q H L Y K T V R
GAAGGCGGGTCGACAGACGTGGATAAGGTCCGGGAGGCCGCGAAGGGCATCGAATTTAACGCCCAGTAGAGGGCTCTCCGGGTCTCATTTCTAACTGCCGTGTTGGTCGTGGAGATGTTCTGCCACGC
CTTCCGCGACCTGTCTGCAGCCTATTCCAGGCCCCTCCGGGCGCCTATTCCAGCCGTTCCCGGTCTCATTTCTAACTGCCGTGTTGGTCGTGGAGATGTTCTGCCACGC
   1090       1100       1110       1120       1130       1140       1150       1160       1170       1180       1190       1200
     350                    360                        370                           380
  I G E I L E N G Q I R E L W K T N K P V K P D P Y L K G Y E W A Q G L S E Q G G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTGCCAGTTGAAGCACTCAACACCTTTGTTATATTGGTCTAGGTATAAAATTTTCCAATACTTACCCGTGTCCCCAATTCGCTCGTTCCACC
   1210       1220       1230       1240       1250       1260       1270       1280       1290       1300       1310       1320
     390
  S H H H H H * *
TTCACATCATCATCATCATTAATGAAAGGGCGATATCCAGCACTGGCCGTTACTAGTGGATCCGGCTGCTAACAAAGCCCGAAAGGAAGCTGAGTTGGCTGCTGCCACCGCT
AAGTGTAGTAGTAGTAGTAGTAATTACTTTCCGCGCTATAGGTCGTGTGACCGCCAATGATCACCTAGCCGACGATTGTTTCGGGCTTTCCTTCGACTCAACCGACGACGGTGCCGA
   1330       1340       1350       1360       1370       1380       1390       1400       1410       1420       1430       1440

GAGCAATAACTAGCATAACCCCTTGGGCCTCTAAACGGGTCTTTTTTGCTGAAAGAGGAACTATATCCGGAGGCGGACTCCCACGGCACGTTG
CTCGTTATTGATCGTATTGGGGAACCCGAGATTTGCCCAGAAACGACTTTCCTCCTTGATATAGGCCTCGCTGAGGGTGCCGTGCAAC
   1450       1460       1470       1480       1490       1500       1510       1520       1530       1540
```

FIG. 80 (Continued)

FIG. 81 - Exemplary Expression Construct for csUBP7_18GC.22

```
CGCTTGGGACTGCCATAGCCTGGCCCGGTGATGCCGGCCACGATGCTCGGCTGTAGAGGATCGAGATCTCGATCCCGCGAAATTAATACAGACTCACTATAGGGAGAGGACCACAACGGTTTC
GCAAACCCTGATCCGACGGGTATCCGACCGGCCACTACGGCCGTGCTACAGCCGCATCCTCTAGCTCTTAAGGCTAGGGCGCTTTAATTATGCTGAGTGATATCCCTCTGGTTGCCAAAG
        10        20        30        40        50        60        70        80        90       100       110       120
                                                                                 M  S  S  S  E  K  K  S  E  E  T  I  K  V  G  I  L  H  S  L  G  T
CCTCTAGAAATAATTTTGTTAAACTTTAAGAGGAGATATACCATGAGTTCATCAGAGAAAAAGTGAAGAGACCATCAAAGTAGGGATTCTCCACAGCTTGAGTGGTAC
GGAGATCTTATTAAAACAAATTGAAATCTTCCTCATAATGGTACTCAAGTAGTCTTAGTCTTTTCTTTTCACTTCTCTGGTAGTTCATCCTAAGAGTGTCGAACTCACCATG
       130       140       150       160       170       180       190       200       210       220       230       240
                                                                                    20
M  S  I  S  E  V  S  L  K  D  A  E  L  M  A  I  E  E  I  N  N  N  G  V  L  G  K  K  L  E  P  I  V  E  D  G  A  S  D
GATGTCAATCTCAGAGTTCTCCTAAAGATGCCGAATTAATGGCCATCGAAGAGATCAACAATAATGGCGGTGTTAGGTAAAAAGTTAGAACCGATCGTGGAAGATGGCGCCTCAGA
CTACAGTTAGAGTCTCAAGAGGATTTCTACGGCTTAATTACCGGTAGTAGTAGCGGTAGTTTCATTTTCAATCTTGGCTAGCACCTTCTACCGCGGAGTCT
       250       260       270       280       290       300       310       320       330       340       350       360
      30                                              40                                              60
W  P  T  F  A  E  K  A  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAACTTTTACAGAAGGACAAGGTGGCAGTAATTTTCGGCGCTTGGACCTCGCAAGTCGGCAAAGCCGTACTCGTCGAAGAAATAA
GACCGGCTGAAGCGACTTTCCGATTCTTGAAAATGTCTTCCTGTTCCACCGTCATTAAAAGCCGCGAACCTGGAGCCGTTCAGCGTTTCGGCATGAGAGGTCAGCAGCTTCTTTTATT
       370       380       390       400       410       420       430       440       450       460       470       480
     70                                              80                                        100
G  L  L  F  Y  P  V  E  Y  E  G  L  E  S  S  P  N  I  F  Y  M  G  A  A  P  N  Q  Q  I  V  P  A  V  K  W  L  F  D  N  G
TGGGCTTCTCTCTATCCGGTTGAATATGAAGGTCTCGAAAGTTCCCAAATATCTTTACATGGGCGCCGCCCAGCAGATCGTGCCAGCAGTTAAATGGCTCTTCGACAACGG
ACCCGAAGAGAAGATAGGCCAACTTATACTTCCAGAGCTTTCAAGGGGTTTATAGAAAATGTACCCGCGGTTGGTCGTCTAGCACGTCGTCAATTTACCGAGAAGCTGTTGCC
       490       500       510       520       530       540       550       560       570       580       590       600
    110                                             120                                             140
K  K  R  F  Y  L  L  G  S  D  Y  Y  V  F  P  R  T  A  N  K  I  I  K  A  Y  L  K  Y  L  G  G  V  V  V  G  E  E  Y  T  P  C
TAAGAAGCGTTTCTACCTCTGGCTCGGATTATGTATTCCCACGCACAGCAACAAGATTATTAAGGCATACTCAAATACCTCGGCGGTGTTGTAGTAGGTGAAGAATACACCCATG
ATTCTTCGCAAAGATGGAGAATGGAGACCGAGCCTAATACATAAGGGTGCGTGGTCGTTCGTTCTAATAATTCCGTATGGAGTTATGAGCCGCCACAACATCATCCACTTCTTATGTGGGGTAC
       610       620       630       640       650       660       670       680       690       700       710       720
    150                                             160                                             180
G  H  T  D  Y  S  S  V  I  N  K  I  K  A  A  K  P  D  V  V  F  N  T  L  N  G  D  S  N  V  A  F  F  K  Q  L  K  D  A  G
TGGTCACACTGACTATAGTTCTGTCATTAATAAAATCAAAGCCGCAAAGCCGGATAGTAGTCGAACGGGATAGTAGCCTTTTTCAAGCAATTAAAGGATGCCGG
ACCAGTGTGACTGATATCAAGACAGTAATTATTTAGTTTCGGCGTTTCGGCTGTCGCAGCATAACTGTCGAGACTTGCGCCCATCCATTCATTACATCGGAAAAAGTCGTTAATTCCCTACGGCC
       730       740       750       760       770       780       790       800       810       820       830       840
    190                                             200                                                                260
I  D  A  N  T  L  P  V  M  S  V  S  I  A  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGAATCAAAGGCATTGGTCCAGATGTATTTAAAAGGTCATCTGCTCACATGAACTATTCCAAAGTGTAGA
CTAACTGCGTTATGTGAGGGACAGTACTCCGCACTCGGAGCGGCCTCCTCTTAGTTTCCGTACCAGTCTCATAAATTTCCAGTAGACCCAGTTGATAAAGGTTCACATCT
       850       860       870       880       890       900       910       920       930       940       950       960
        230                                             240
```

```
       270                    280                       290                      300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAAACAAGGAGTTCGTTGAGAAGTATAAGAAAATATGGGGAGGACCGGGTGACAGATGACCAATCGAGGCGGCATAACTCGGCGTATACTTATGGGCTAAAGCGGTTGA
ATGTGGCCTTTGTTCCTCAAGCAACTCTTTATATTCTTTTTCATAGTCCACTGTCTACTGGGTTAGCTCCGCCGTATGTAGCCGCATATGAATACCCGATTTCGCCAACT
   970       980       990       1000      1010      1020      1030      1040      1050      1060      1070      1080

310                    320                       330                      340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAAGGGCATCGAATTTAACGCCCCAGAGGGCCCAGTAAAGATTGACGGCGACAACCAGCACCTCTACAAGACGGTGCG
CTTCCGCCCCAGCTGTCTGCACACCTATTCCAGGCGCCCCGCGGCGTTCCCGTAGCTTAAATTGCGGGTCTCCCGGGTCATTTCTAACTGCCGTCGTGGAGATGTTCTGCCACGC
   1090      1100      1110      1120      1130      1140      1150      1160      1170      1180      1190      1200

350                    360                       370                      380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTCGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTGCCAGTTCAAGCACTCAACACCTTTGTTATTTGTCTAGTGATAAATTTCCAATACTTACCCGTGTCCCAATTCGCTCGTTCCACC
   1210      1220      1230      1240      1250      1260      1270      1280      1290      1300      1310      1320

390
S  H  H  H  H  H  *  *
TTCACATCATCATCATCATCATTAATGAAAGGGCGATATCCAGCACACACTGGCGCTGCTACTAGTGGATCGGCTGCTAACAAAGCCCGAAAGGAAGCTGAGTTGGCTGCTGCCACCGCT
AAGTGTAGTAGTAGTAGTAGTAATTACTTTCCCGCTATAGGTCGTGTGACACCTAGCCGACCAATGATCACCTAGCCGACGATTGTTCGGGCTTTCCTTGACTCAACGACGACGGTGCCGA
   1330      1340      1350      1360      1370      1380      1390      1400      1410      1420      1430      1440

GAGCAATAACTAGCATAACCCCTTGGGCCTCTAAACGGGTCTTTGAGGGGTTTTTTGCTGAAAGAGGAACTATATCCGGAGGCGACTCCCACGGCACGTTG
CTCGTTATTGATCGTATTGGGGAACCCCGAGAATTGCCCAGAACTCCCCAAAAAACGACTTTCCTCCTTGATATAGGCCTCGCTGAGGGTGCCGCGTGCAAC
   1450      1460      1470      1480      1490      1500      1510      1520      1530      1540
```

FIG. 81 (Continued)

FIG. 82 - Exemplary Expression Construct for csUBP7_186C.23

```
CGCTTGGGACTGCCATAGCTGGCCCGGTGATGCCGGCCACGATGCGTCGGCGTAGAGGATCGAGATCTCGATCCCGCGAAATTAATACAGACTCACTATAGGGAGACCACAACGGTTTC
GCGAACCCTGATCCGACGGGCCACTACGGCCGGTGCTACGGCCCGCATCCTCCTAGCTGTCAGCAGGGCGCTTTAATTATGCTGAGTGATATCCCTCGTGTTGCCAAAG
        10        20        30        40        50        60        70        80        90        100       110       120

M   S   S   S   E   K   E   K   S   E   E   T   I   K   V   G   I   L   H   S   L   S   G   T
CCTCTAGAAATAATTTGTTTAAGTTTAAGAAGGAGATATACCATGAGTTCATCAGAATCAGAAAAAGAAAAAAGTGAAGAGACCATCAAAGTAGGGATTCTCCACAGCTTGAGTGGTAC
GGAGATCTTTATTAAACAAATTCAAATTCTTCCTCTATATGGTACTCAAGTAGTCTTAGTCTTTTTCTTTTTCATTCTCTGGTAGTTCATCCCTAAGAGTGTCGAACTCACCATG
        130       140       150       160       170       180       190       200       210       220       230       240

M   S   I   S   E   V   S   L   K   D   A   E   L   M   A   I   E   E   I   N   N   N   G   V   L   G   K   K   L   E   P   I   V   E   D   G   A   S   D
GATGTCAATCTCAGAGTTCCTTAAAGATGCCGAATTAATGGCGATCGAAGAGATCAACAACAATGGCGGTGTGTTAGGTAAAAAGTTAGAACCGATCGTGGAAGATGGCGCCTCAGA
CTACAGTTAGAGTCTCAAGGAATTTCTACGGCTTAATTACCGCTCTAGCTCTTCTACGTTGTTGTTATTACCGCCACACAATCATTTTTCAATCTTGGCTAGCACCTTCTACCGCGGAGTCT
        250       260       270       280       290       300       310       320       330       340       350       360

W   P   T   F   A   E   K   A   K   K   L   L   Q   K   D   K   V   A   V   I   F   G   A   W   T   S   A   S   R   K   A   V   L   P   V   V   E   E   N   N
CTGGCCGACCTTCGCTGAAAAGGCTAAGAAACTTTTACAGAAGGACAAGGTTGCAGTAATTTTCGGCGCTTGGACCTGCAGCTCGCAAAGCCGTACTCCCAGTCGTCGAAGAAATAA
GACCGGCTGAAGCGACTTTTCCGATTCTTTGAAAATGTCTTCCTGTTCCATTAAAAGCCGCGAACCTGGAGCCGTTCAGCGTTTCGGCATGAGAGGTCAGCAGCTTCTTTTATT
        370       380       390       400       410       420       430       440       450       460       470       480

G   L   L   F   Y   P   V   H   Y   E   G   L   E   S   S   P   N   I   F   Y   M   G   A   A   P   N   Q   Q   I   V   P   A   V   K   W   L   F   D   N   G
TGGGCTTCTCTCTATCCGGTTCATTATGAAGGTCTCGAAAGTTCCCAAATATCTTTACATGGGCGCCGCCCCAAACCAGCAGATCGTGCCAGCAGTTAAATGGCTCTTCGACAACGG
ACCCGAAGAGATAGGCCAAGTAATACTTCCAGAGCTTTCAAGGGGTTTATAGAAATGTACCCGCGGCGGGGGTTTGGTCGTCTAGCACGGTCGTCAATTTACCGAGAAGCTGTTGCC
        490       500       510       520       530       540       550       560       570       580       590       600

K   K   R   F   Y   L   L   G   S   D   Y   Y   V   F   P   P   R   T   A   N   K   I   H   K   A   Y   L   K   Y   L   G   G   V   V   V   G   E   E   Y   T   P   C
TAAGAAGCGTTTCTACCTCTTGGGCTCGGATTATGTATTCCCACGCAGACAGCAGCAAACAAGATTATTAAGGCATACCTCAAATACCTCGGCGGTGTTGTAGTAGGTGAAGAATACACCCCATG
ATTCTTCGCAAAGATGGAGAATGGAGAACCCGAGCCTAATACATAAGGGTGCGTCTGTCGTTGGTTCGTCTAGCACCCCGTACATCATCCACTTCTTATGTGGGGTAC
        610       620       630       640       650       660       670       680       690       700       710       720

G   H   T   D   Y   S   S   V   I   N   K   I   K   A   A   K   P   D   V   V   F   N   T   L   N   G   D   S   N   V   A   F   F   K   Q   L   K   D   A   G
TGGTCACACTGACTATAGTTCTGTCATTAATAAAATCAAAGCCGCAAAGCCGGATGTCGTATTTAACACTCTGAACGGGGATAGTAGCCTTTTTCAAGCAATTAAAGGATGCCGG
ACCAGTGTGACTGATATCAAGACAGTAATTATTTTAGTTTCGGCGTTTCGGCTGCAGCATATACATTCGGAAAAGTTCGTTAATTTCCTACGGCC
        730       740       750       760       770       780       790       800       810       820       830       840

I   D   A   N   T   L   P   V   M   S   V   S   I   A   E   E   E   I   K   G   I   G   P   E   Y   L   K   G   H   L   V   T   W   N   Y   F   Q   S   V   D
GATTGACGCAAATACACTCCCTGTCATGAGCGTGAGCATCGCCGAGGAGATCAAAGGCATTGGTCCAGAGTATTTAAAAGGTCATCTGTCACATGAACTATTCCAAAGTGTAGA
CTAACTGCGTTATGTGAGGGACAGTACTCGCACGTCGTAGCGCTCCTCCTAGTTTCCGTAACCAGTCTCATAAATTTCCAGTAGACCAGTTCATGAAGGTTTCACATCT
        850       860       870       880       890       900       910       920       930       940       950       960
```

```
         270                280                 290                300
T P E N K E F V E K Y K K K Y G E D R V T D D P I E A A Y I G V Y L W A K A V E
TACACCGGAAAACAAGGAGTTCGTTGAGAAGTATAAGAAAAAGTATGGGGAGGACCGGGTGACAGATGACCAATCGAGGCGGCATAACATCGGCGTATACTTATGGGCTAAAGCGGTTGA
ATGTGGCCTTTGTTCCTCAAGCAACTCTTTATATTCTTTTCATACCCCTCCTGGCCCACTGTCTACTGGGTTAGCTCCGCTATGTAGCCGCATATGAATACCCGATTTCGCCAACT
       970        980        990       1000       1010       1020       1030       1040       1050       1060       1070       1080

310                320                 330                340
K A G S T D V D K V R E A A K G I E F N A P E G P V K I D G D N Q H L Y K T V R
GAAGGCGGGGTCGACAGACGTGGATAAGGTCCGGGAGGCCATCGAATTTAACGCCCAGTAGGGCCCAGTAAAGATTGACGGCGACAACCAGCACCTCTACAAGACGGTGCG
CTTCCGCCCCAGCTGTCTGCACCTATTCCAGGCCCTCCGGTAGCTTAAATTGCGGGTCATTTCTAACTGCCGCTGTTGGTCGTGGAGATGTTCTGCCACGC
      1090       1100       1110       1120       1130       1140       1150       1160       1170       1180       1190       1200

350                360                 370                380
I G E I L E N G Q I R E L W K T N K P V K P D P Y L K G Y E W A Q G L S E Q G G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTGAAGCACTCAACACCTTTGTTATTTGTCTAGGTATAAAATTTCCAATACTTACCCGTGTCCCCAATTCGCTCGTTCCACC
      1210       1220       1230       1240       1250       1260       1270       1280       1290       1300       1310       1320

390
S H H H H H * *
TTCACATCATCATCATCATTAATGAAAGGGCGATATCCAGCACTGGGCGTCCGGCCGTTACTAGTGGATCGGATCGGCTGCTAACAAAGCCCGAAAGGAAGCTGAGTTGGCTGCTGCCACCGCT
AAGTGTAGTAGTAGTAGTAGTAATTACTTTCCCGCTATAGGTCGTGTGACCTAGGCCGCAATGATCACCTAGCCGCTTTCGGGCTTTCCTTCGACTCAACCGACGACGGTGGCGA
      1330       1340       1350       1360       1370       1380       1390       1400       1410       1420       1430       1440

GAGCAATAACTAGCATAACCCCTTGGGGCCTCTAAACGGGTCTTTGAGGGGTTTTTTGCTGAAAGAGGAACTATATCCGGAGGCGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGCGTGCAAC
      1450       1460       1470       1480       1490       1500       1510       1520       1530       1540
```

FIG. 82 (Continued)

FIG. 83 - Exemplary Expression Construct for csUBP7_186C.24

```
CGCTTGGGACTGCCATAGCCTGGCCCGGTGATGCCGGCCACGATGCTCGATCCCGCGTAGAGGATCGATTAATACGACTCACTATAGGGAGACCACAACGGTTTC
GCGAACCCTGATCCGACGGGTATCCGACGGCCACTACGGCCGTGCTACGGCCCGCATCCTCCTAGCTCCAGCCTAGGGCGCTTTAATTATGCTGAGTGATATCCCTGTGTTGCCAAAG
         10        20        30        40        50        60        70        80        90       100       110       120
                                                                      M  S  S  S  E  K  S  E  E  T  I  K  V  G  I  L  H  S  L  S  G  T
CCTCTAGAAATAATTTGTGTTAAACTTTAAGAAGGAGATATACCATGAGTTCATCAGAATCAGAAAAGAAAAGAGAAGAGACCATCAAAGTGAAGGATTCTCCACAGCTTGAGTGGTAC
GGAGATCTTTATTAAAACAATTTGAAATTCTTCCTCTATATGGTACTCAAGTAGTCTTAGTCTTTTCTTTTCACTTCCTAGAGTGTCGAACTCACCATG
        130       140       150       160       170       180       190       200       210       220       230       240
                30                                  40                                  60
 M  S  I  S  E  V  S  L  K  D  A  E  L  M  A  I  E  E  I  N  N  N  G  V  L  G  K  K  L  E  P  I  V  E  D  G  A  S  D
GATGTCAATCTCAGAGTTCTCCTAAAAGATGCCGAATTAATGGCCATCGAAGAGATCAACAACAATGGCGGTGTGTTAGGTAAAAAGTTAGAACCGATCGTGGAAGATGGCGCCTCAGA
CTACAGTTAGAGTCTCAAGAGGATTTTCTACGGCTTAATTACCGGTAGTCTTCTGTTGTTATTACCGCCACACAATCATTTTCAATCTTGGCTAGCACCTTCTACCGCGGAGTCT
        250       260       270       280       290       300       310       320       330       340       350       360
                70                                  80                                 100
 W  P  T  F  A  E  K  A  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAAACTTTTACAGAAGGACAAGGTGGCAGTGATTTTCGGCGCTTGGACCTGCAGTCCCAAAGCCGCAAAGCCGTCAAGAAATAA
GACCGGCTGAAGCGACTTTCCGATTCTTGAAAATGTCTTCCTGTTCCACCGCATTAAAGCCGCGAACCTGGAGCCGTTCGAGCGTTCAGCGATGAGGTCAGCAGCTTCTTTATT
        370       380       390       400       410       420       430       440       450       460       470       480
               110                                 120                                 140
 G  L  L  F  Y  P  V  T  Y  E  G  L  E  S  S  P  N  I  F  Y  M  G  A  A  P  N  Q  Q  I  V  P  A  V  K  W  L  F  D  N  G
TGGGCTTCTCTCTATCCGGTTACCTACGAAGGTCTCGAGAAGTTCCCCAAATATCTTTACATGGGCGCCGCCCCCAAACCAGCAGATCGTGCCAGCAGTTAAATGGCTCTTCGACAACGG
ACCCGAAGAGAGATAGGCCAATGGATGATATGGGAAGCTCTTCAAGGGGTTTATAGAAATGTACCGCGGCGGGGGTTTGGTCGTCTAGCACGGTCGTCAATTTACCGAGAAGCTGTTGCC
        490       500       510       520       530       540       550       560       570       580       590       600
               150                                 160                                 180
 K  K  R  F  Y  L  L  G  S  D  Y  V  F  P  R  T  A  N  K  I  I  K  A  Y  L  K  Y  L  G  G  V  V  V  G  E  E  Y  T  P  C
TAAGAAGCGTTTCTACCTTCTCGGCTCCGATTATGTATTCCCACGCACAGCAAACAAGATTATTAAGGCATACCTCAAATACCTCGGCGGTGTTGTAGTAGTGAAGAATACACCCCATG
ATTCTTCGCAAAGATGGAGAAGCCGAGGCCTAATACATAAGGGTGCGTGCTGTGCGTTCGTGGGCCGACACTACCATTATGGAGCCGCCACAACATCATCCACTTCTTATGTGGGTAC
        610       620       630       640       650       660       670       680       690       700       710       720
               190                                 200                                 220
 G  H  T  D  Y  S  S  V  I  N  K  I  K  A  A  K  P  D  V  V  F  N  T  L  N  G  D  S  N  V  A  F  F  K  Q  L  K  D  A  G
TGGTCACACTGACTATAGTTCTGTCATTAATAAAATCAAAGCCGCAAAGCCAGACGTTCGTATTTAACACTCTGAACGGGGATAGTAGCCTTTTTCAAGCAATTAAAGGATGCCGG
ACCAGTGTGACTGATATCAAGACAGTAATTATTTTAGTTTCGGCGTTCGGTCTGCAAGCATAAATTGTGAGACTTGCCATCCATTACATTCGGAAAAAGTTCGTTAATTTCCTACGGCC
        730       740       750       760       770       780       790       800       810       820       830       840
               230                                 240                                 260
 I  D  A  N  T  L  P  V  M  S  V  S  I  A  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGATCAAAGGCATTGGTCCAGAGTATTTAAAAGGTCATCTGGTCACATGGAACTATTTCCAAAGTGTAGA
CTAACTGCGTTTATGTGAGGGACAGTACTCCGCACTCGTAGCGGCCCTCCTAGTTTCCGTACCCAGTGTCCATAAATTTTCCAGTAGACCCAGTGTCACCATCT
        850       860       870       880       890       900       910       920       930       940       950       960
```

```
         270                    280                    290                    300
T P E N K E F V E K Y K K K Y G E D R V T D D P I E A A Y I G V Y L W A K A V E
TACACCGGAAAACAAGGAGTTCGTTGAGAAATATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTCATACCCCTCCTGGCCCACTGTCTACTGGGTTAGCTCCGCCTATGTAGCCGCATATGAATACCCGATTTCGCCAACT
     970        980        990       1000       1010       1020       1030       1040       1050       1060       1070       1080

310                    320                    330                    340
K A G S T D V D K V R E A A K G I E F N A P E G P V K I D G D N Q H L Y K T V R
GAAGGCGGGGTCGACAGACGTGGATAAGGTCCGGGAGGCCGCGAAGGGCATCGAATTTAACGCCCAGAGGGCTCCGGGTCTCCGGGTCTCATTTCTAACTGCCGCTGTTGGTCGTGGAGATGTTCTGCGCACGC
CTTCCGCCCCAGCTGTCTGCACCTATTCCAGGCGCGTTCCGGCGCTTCCGCGGCCCTCCGGGCGCTTCCGGGCCTTCGGGGTCTCATTTCTAACTGCCGCTGTTGGTCGTGGAGATGTTCTGCGCACGC
    1090       1100       1110       1120       1130       1140       1150       1160       1170       1180       1190       1200

350                    360                    370                    380
I G E I L E N G Q I R E L W K T N K P V K P D P Y L K G Y E W A Q G L S E Q G G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTTGCCAGTTCAAGCACTCAACACCTTTTGTTTATTTCGTCTAGGTATAAAATTTCCAATACTTACCCGTGTCCCCAATTCGCTCGTTCCACC
    1210       1220       1230       1240       1250       1260       1270       1280       1290       1300       1310       1320

390
S H H H H H * *
TTCACATCATCATCATCATTAATGAAAGGGCGATATCCAGCACACTGGCGCCGCTTACTAGTGGATCCGGCTGCTAACAAAGCCCGAAAGGAAGCTGAGTTGCTGCTGCCACCGCT
AAGTGTAGTAGTAGTAGTAGTAATTACTTTCCCGCTATAGGTCGTGTGACCGCCAATGATCACCTAGGCCGACGATTGTTTCGGGCTTCCTTCGACTCAACCGACGACGTGCCGA
    1330       1340       1350       1360       1370       1380       1390       1400       1410       1420       1430       1440

GAGCAATAACTAGCATAACCCCTTGGGCCTCTAAACGGGTCTTGAGGGGTTTTTTGCTGAAAGGAGGAACTATATCCGGAGGACTCCCACGGCACGTTG
CTCGTTATTGATCGTATTGGGGAACCCGAGAATTGCCCAGAAACGACTTTCCTCCTTGATATAGGCCTCGCTGAGGGTGCCGCGTGCAAC
    1450       1460       1470       1480       1490       1500       1510       1520       1530       1540
```

FIG. 83 (Continued)

FIG. 84 - Exemplary Expression Construct for csUBP7_186C.25

```
                    270                         280                         290                         300
      T  P  E  N  K  E  F  V  E  K  Y  K  K  Y  G  E  D  R  V  T  D  D  P  I  E  A  A  Y  I  G  V  Y  L  W  A  K  A  V  E
      TACACCGGAAAACAAGGAGTTCGTTGAGAAGTATAAGAAAAAGTATGGGGAGGACCGGGTCGACAGATGACCCAATCGAGGCGGCATACATCGGCGTATACTTATGGGCTAAAGCGGTTGA
      ATGTGGCCTTTGTTCCTCAAGCAACTCTTTATATTCTTTTCATACCCCTCCTGGCCCACTGTCTACTGGGTTAGCTCCGCTATGTAGCCGCATATGAATACCCGATTTCGCCAACT
                    970         980         990        1000        1010        1020        1030        1040        1050        1060        1070        1080
                    310                         320                         330                         340
      K  A  G  S  T  D  V  D  K  V  R  E  A  A  K  G  I  E  F  N  A  P  E  G  P  V  K  I  D  G  D  N  Q  H  L  Y  K  T  V  R
      GAAGGCGGGGTCGACAGACGTGGATAAGGTCCGGGAGGCCGCGAAAGGGCATCGAATTTAACGCCCAGAGGGCCCAGTAAAGATTGACGGCGACAACCAGCACCTCTACAAGACGGTGCG
      CTTCCGCCCCAGCTGTCTGCACCTATTCCAGGCCCTCCGGCGCTTCCCGTAGCTTAAATTGCGGGTCTCATTTCTAACTGCCGCTGTTGGTCGTGGAGATGTTCTGCCACGC
                   1090        1100        1110        1120        1130        1140        1150        1160        1170        1180        1190        1200
                    350                         360                         370                         380
      I  G  E  I  L  E  N  G  Q  I  R  E  L  W  K  T  N  K  P  V  K  P  D  P  Y  L  K  G  Y  E  W  A  Q  G  L  S  E  Q  G  G
      TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
      ATAACCACTCTAGGACCTCTCGCCAGTTTAAGCACTCAACACCTTTGTTATTTGGTCTAGTATAAATTTCCAATACTACCCGTGTCCCCAATTCGCTCGTTCCACC
                   1210        1220        1230        1240        1250        1260        1270        1280        1290        1300        1310        1320
                    390
      S  H  H  H  H  H  *  *
      TTCACATCATCATCATCATCATTAATGAAAGGGCGATATCCAGCACACACTGGCCGCCGTTACTAGTGGATCCGGCTGCTAACAAAGCCCGAAAGGAAGCTGAGTTGGCTGCTCCACCGCT
      AAGTGTAGTAGTAGTAGTAGTAATTACTTTCCCGCTATAGGTCGTGTGACACCGGCGGCAATGATCACCTAGGCCGACGATTGTTCGGGCTTCCTTGACTCAACCGACGAGGTGGCGA
                   1330        1340        1350        1360        1370        1380        1390        1400        1410        1420        1430        1440

GAGCAATAACTAGCATAACCCCTTGGGCCTCTAAACGGGTCTTTTTTGCTGAAAGAGGAACTATATCCGGAGGACTCCCACGGCACGTTG
      CTCGTTATTGATCGTATTGGGAACCCCGGAGATTGCCCAGAAACGACTTTCCTTCGTTGATATAGGCCTCGCTGAGGGTGCCGCGTGCAAC
                   1450        1460        1470        1480        1490        1500        1510        1520        1530        1540
```

FIG. 84 (Continued)

FIG. 85 - Exemplary Expression Construct for csUBP7_18GC.26

```
        270                    280                    290                    300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAAACAAGGAGTTCGTTGAGAAATATAAGAAAAGTATGGGAGGAGACCGGGTGACAGATGACCAATCGAGGCGGCATACATCGGCGTATACTTATGGCTAAAGCGGTTGA
ATGTGGCCTTTGTTCCTCAAGCAACTCTTTATATTCTTTTCATAGCCACTGTCCTACTGGGTTAGCTCCGCCGTATGTAGCCGCATATGAATACCCGATTTCGCCAACT
     970        980        990       1000       1010       1020       1030       1040       1050       1060       1070       1080

310                    320                    330                    340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAAGGGCATCGAATTTAACGCCCAGAGGGCCCAGTGGTCAATTTCTAACTGCCGCTGTTGGTCGTGGAGATGTTCTGCCACGC
CTTCCGCCCCAGCTGTCTGCACCTATTCCAGGCCCTCCGGCGCTTCCCGTAGCTTAAATTGCGGGGTCTCCCGGGTCATTTCTAACTGCCGCTGTTGGTCGTGGAGATGTTCTGCCACGC
    1090       1100       1110       1120       1130       1140       1150       1160       1170       1180       1190       1200

350                    360                    370                    380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTCGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCCTCTTGCCAGTTTAAGCACTCAACACCTTTGTTATTGGTCTAGGTATAAAAATTTTCCAATACTACCCGTGCCCAATTCGCTCGTTCCACC
    1210       1220       1230       1240       1250       1260       1270       1280       1290       1300       1310       1320

390
S  H  H  H  H  H  *  *
TTCACATCATCATCATCATTAATGAAAGGGCGATATCCAGCACACTGGCGCCGTTACTAGTGGATCCGGCTGCTAACAAAGCCCGAAAGGAAGCTGAGTTGCTGCTGCCACCGCT
AAGTGTAGTAGTAGTAGTAATTACTTTCCCGCTATAGGTCGTGTGACCGCCAATGATCACCTAGGCCGACGATTGTTTCGGGCTTTCCTTGACTCAACCGACGACGGTGCCGA
    1330       1340       1350       1360       1370       1380       1390       1400       1410       1420       1430       1440

GAGCAATAACTAGCATAACCCCCTTGGGCCTCTAAACGGGTCTTTTTGCTGAAAGAGGAACTATATCCGGAGGACTCCCACGGCACGTTG
CTCGTTATTGATCGTATTGGGGAACCCCGAGAATTGCCCAGAAACTCCCCAAAAAAACGACTTTCCTCCTTGATATAGGCCTCGCTGAGGGTGCCGTGCAAC
   1450        1460       1470       1480       1490       1500       1510       1520       1530       1540
```

FIG. 85 (Continued)

FIG. 86 - Exemplary Expression Construct for csUBP7_186C.27

```
CGCTTGGGACTGCCATAGCTGGCCCGGTGATGCCGGCCACGATGCGTCGATGCAGATCTCGATCCCGCGTAGAGATCGAGAATTAATACAGCTCACTATAGGGAGACCACAACGGTTTC
GCGAACCCTGATCCGACGGGCCACTACGGCCGGTGCTACGGCCCATCCTAGCTCCTAGCTCCTAGCTAGGGCGCTTTAATTATGCTGAGTGATATCCCTCGTGTTGCCAAAG
         10        20        30        40        50        60        70        80        90       100       110       120
                                                                                                                                  T
CCTCTAGAAATAATTTTGTGTTAAACTTTAAGAAGGAGATATACCATGAGTTCATCAGAATCAGAAAAGAGTGAAGAGACCATCAAAGTAGGAGATTCTCCACAGCTTGAGTGGTAC
GGAGATCTTATTAAAACAAATTGAAATTCTTCCTCTATATGGTACTCAAGTAGTCTTAGTCTTTTCTTTTTCACTTCTCTGGTAGTTCATCCTAAGAGTGTCGAACTCACCATG
         130       140       150       160       170       180       190       200       210       220       230       240

M  S  S  S  E  K  E  K  S  E  E  T  I  K  V  G  I  L  H  S  L  S  G  T
                                                    10                                  20

GATGTCAATCTCAGAGTTCCTTAAAGATGCCGAATTCATGGCCATCGAAGAGATCAACAATAATGGCGGTGTGTTAGGTAAAAAGTTAGAACCGATCGTGGAAGATGGCGCCTCAGA
CTACAGTTAGAGTCTCAAGGAATTTCTACGGCTTAAGTACCGGTAGCTACGTTGTATTACCAATCATTTTCAATCTTGGCTAGCACCTTCTACCGCGGAGTCT
         250       260       270       280       290       300       310       320       330       340       350       360

M  S  I  S  E  V  S  L  K  D  A  E  L  M  A  I  E  E  I  N  N  N  G  G  V  L  G  K  K  L  E  P  I  V  E  D  G  A  S  D
         30                                40                                50                               60

CTGGCCCGACCTTCGCTGAAAAGGCTAAGAAACTTTTACAGAAGGACAAGGTGGCAGTAATTTTCGGCGCTTGACCTGCCAAGCCGCGTACTCGCCAGTCGTCGAAGAAATAA
GACCGGCTGAAGCGACTTTCCGATTCTTTGAAAATGTCTTCCTGTTCCACCGTCATTAAAAGCCCGCGAACCTGGAGCCGTTCGAGCGTTTCAGCGTTCAGCAGCTTCTTTTATT
         370       380       390       400       410       420       430       440       450       460       470       480

W  P  T  F  A  E  K  A  K  K  L  L  Q  K  D  K  V  A  V  I  F  G  A  W  T  S  A  S  R  K  A  V  L  P  V  V  E  E  N  N
         70                               80                                90                              100

TGGGCTTCTCTCTATCCGGTTCTGTATGAAGGTCTCGAAAGTTCCCAAATATCTTTTACATGGGCGCCGCCCCAAACCAGCAGATCGTGCCAGCAGTTAAATGCTCTTCGACAACGG
ACCCCGAAGAGAAGATAGGCCAAGACATACTTCCAAGGGGTTTAGAAGTTTATAGAAAATGTACCCGGCACGTCGTCTAGCACGTTCAATTTACCGAGAAGCTGTTGCC
         490       500       510       520       530       540       550       560       570       580       590       600

G  L  L  F  Y  P  V  L  Y  E  G  L  E  S  S  P  N  I  F  Y  M  G  A  A  P  N  Q  Q  I  V  P  A  V  K  W  L  F  D  N  G
         110                              120                               130                             140

TAAGAAGCGTTTCTACCTCTTCGGGCCTCGGATTATGTATTCCCACGCACAGCAGACAAACAAGATTATTAAGGCATACCTCAAATACCTCGGCGGTGTTGTAGTAGTGAAGAATACACCCCATG
ATTCTTCGCAAGATGGAGAACCGAGCCTAATACATAAGGCTGCTGTCGTTCGTCATTGTCTAATAATTCCGTATGGAGTTTATGGAGCCGCCACAACATCATCCACTTCTTATGTGGGTAC
         610       620       630       640       650       660       670       680       690       700       710       720

K  K  R  F  Y  L  L  G  S  D  Y  V  F  P  R  T  A  N  K  I  I  K  A  Y  L  K  Y  L  G  G  V  V  V  G  E  E  Y  T  P  C
         150                              160                               170                             180

TGGTCACACTGACTATAGTTCTGTCATTAATAAATCAAAGCCGCAAAGCCAGACGTTCGCAGCATGTTGTCCGTATTTAACACTCTGAACTGTGAGACTTGTGAAAAATTCGGAAAAGTTCGTTAATTCCTACGGCC
ACCAGTGTGACTGACTGATATCAAGACAGTAGTATTTTAGTGTTTCGGCGTTGCGGCGTTGCCGCGTTCAAAATCATTACATCGGAGATTTAAAATTCCATGAAAATTTTCAAGGTTCAAAGGTTCAATGGTGATGGCC
         730       740       750       760       770       780       790       800       810       820       830       840

G  H  T  D  Y  S  S  V  I  N  K  I  K  A  A  K  P  D  V  V  F  N  T  L  N  G  D  S  N  V  A  F  F  K  Q  L  K  D  A  G
         190                              200                               210                             220

GATTGACGCAAATACACTCCCTGTCATGAGCGTGAGCATCGCCGAGGAGATCGCCGAAGGCATTGGTCCAGAGTATTTAAAAGTCATCTGTCACATGAACTATTTCCAAAGTGTAGA
CTAACTGCGTTATGTGAGGGACAGTACTCGCACTCGTAGCGGCCTCCCTAGTTTCCGTAACCAGTCTCATAAATTTTCCAGTAGACCTTGATAAAGGTTTCACATCT
         850       860       870       880       890       900       910       920       930       940       950       960

I  D  A  N  T  L  P  V  M  S  V  S  I  A  E  E  I  K  G  I  G  P  E  Y  L  K  G  H  L  V  T  W  N  Y  F  Q  S  V  D
         230                              240                               250                             260
```

```
       270                    280                    290                    300
 T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAAACAAGGAGTTCGTTGAGAAATATAAGAAAAAGTATGGGGAGGACCGGGTGACAGATGACCAATCGAGGCGGCATACATCGGCGTATACTTATGGCTAAAGCGGTTGA
ATGTGGCCTTTGTTCCTCAAGCAACTCTTTATATTCTTTTTCATATCCCTCTGGGTTAGCTCCGCCGTATGTAGCCGCATATGAATACCCGATTTCGCCAACT
    970        980        990       1000       1010       1020       1030       1040       1050       1060       1070       1080

310                    320                    330                    340
 K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCCAGAGGGCCCAGTAAAGATTGACGGCGACAACCAGCACCTCTACAAGACGGTGCG
CTTCCGCCCCAGCTGTCTGCACACCTATTCCAGGCCCCTCCCGGCGCTTCCCGTAGCTTAAATTGCGGGGTCTCCCGGGTCATTTCTAACTGCCGCTGTTGGTCGTGGAGATGTTCTGCCACGC
   1090       1100       1110       1120       1130       1140       1150       1160       1170       1180       1190       1200

350                    360                    370                    380
 I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
ATAACCACTCTAGGACCTCTGCCAGTTTAAGCACTCAACACCTTTTGTTATTTGGTCTAGTGATAAATTTTCCAATACTTACCCGTCCCCAATTCGCTCGTTCCACC
   1210       1220       1230       1240       1250       1260       1270       1280       1290       1300       1310       1320

390
 S  H  H  H  H  H  *  *
TTCACATCATCATCATCATCATTAATGAAAGGGCGATATCCAGCACTGGGCGTTACTAGTGGATCCGGCTGCTAACAAAGCCCGAAAGGAAGCTAGTTGGCTGCTCCACCGCT
AAGTGTAGTAGTAGTAGTAGTAATTACTTTCCCGCTATAGGTCGTGTGACCTAGCCGACGATTGTTCCTTCGACTCAACCGACGACGGTGCCGA
   1330       1340       1350       1360       1370       1380       1390       1400       1410       1420       1430       1440

GAGCAATAACTAGCATAACCCCTTGGGCCTCTAAACGGGTCTTTTTGCTGAAAGAGGAACTATATCCGGAGCGACTCCCACGGCACGTTG
CTCGTTATTGATCGTATTGGGGAACCCCGAGAATTGCCCAGAAACGACTTTCCTTCCTTGATATAGGCCTCGCTGAGGGTGCCGTGCAAC
   1450       1460       1470       1480       1490       1500       1510       1520       1530       1540
```

FIG. 86 (Continued)

FIG. 87 – Exemplary Expression Construct for csUBP7_186C.28

```
CGCTTGGGACTGCCATAGCCTGGCCCGGTGATGCCGGCCACGATGCTCGGCGTAGAGGATCGAGATCTCGATCCCGCGAAATTAATACGACTCACTATAGGGAGACCACAACGGTTTC
GCGAACCCTGATCCGACCGGGCCACTACGGCCGTGCTACGGCCATCCTAGCTCCTAGCTCCAGCCCATGCTCTAGAGCTAGGGCGCTTTAATTATGCTGAGTGATATCCCTGTGTTGCCAAAG
         10        20        30        40        50        60        70        80        90        100       110       120

M  S  S  S  E  K  K  S  E  E  T  I  K  V  G  I  L  H  S  L  G  T
CCTCTAGAAATAATTTGTGTTAACTTTAAGAAGGAGATATACCATGAGTTCATCGAGTCATCAGAGAATCAGAAAAAAGAAGAGACCATCAAAGTAGGGATTCTCCACAGCTTGAGTGGTAC
GGAGATCTTTATTAAACACAATTGAAATTCTTCCTCTATATGGTACTCAAGTAGTCTTAGTCTTTTCTTTTCACTTCTCTGGTAGTTCATCCTAAGAGGTGTCGAACTCACCATG
         130       140       150       160       170       180       190       200       210       220       230       240

M  S  I  S  E  V  S  L  K  D  A  E  L  M  A  I  E  E  I  N  N  N  G  V  L  G  K  K  L  E  P  I  V  E  D  G  A  S  D
GATGTCAATCTCAGAGTTCCTTAAAGATGCCGAATTAATGGCCATCGAAGAGATCAACAACAATGGCGGTGTGTTAGGTAAAAAGTTAGAACCGATCGTGGAAGATGGCGCCTCAGA
CTACAGTTAGAGTCTCAAGGAATTTCTACGGCTTAATTACCGGTACTTAATTACCGCCACACAATCAATTTTCAATCTTGGCTAGCACCTTCTACCGCGGAGTCT
         250       260       270       280       290       300       310       320       330       340       350       360

W  P  T  F  A  E  K  K  A  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAAACTTTTACAGAAGGACAAGGTTGGCAGTAATTTTCGGCGCTTGGACCTGTCCAGTCGTCAGAAGCCCGTACTCGCAAGTCGTCGAAGAAATAA
GACCGGCTGGAAGCGACTTTTCCGATTCTTTGAAAATGTCTTCCTGTTCCACCGTCATTAAAAGCCGCGAACCTGGAGCCGTTCAGCGTTTCGGCATGAGAGGTCAGCAGCTTCTTTTATT
         370       380       390       400       410       420       430       440       450       460       470       480

G  L  L  F  Y  P  V  Q  Y  E  G  L  E  S  S  P  N  I  F  Y  M  G  A  A  P  N  Q  Q  I  V  P  A  V  K  W  L  F  D  N  G
TGGGCTTCTCTTCTATCCGGTTCAGTATGAAGGTCTCGAAAGTTCCCAAATATCTTTTACATGGGCGCGCCCCAAACCAGCAGATCGTGCCAGCAGTTAAATGGCTCTTCGACAACGG
ACCCGAAGAGAAGATAGGCCAAGTCATACTTCCAGAGCTTTCAAGGGGTTTATAGAAAATGTACCCGCGCGGGGTTTGGTCGTCTAGCACGGTCGTCAATTTACCGAGAAGCTGTTGCC
         490       500       510       520       530       540       550       560       570       580       590       600

K  K  R  F  Y  L  L  G  S  D  Y  Y  V  F  P  R  T  A  N  K  I  H  K  A  Y  L  K  Y  L  G  G  V  V  V  G  E  E  Y  T  P  C
TAAGAAGCGTTTCTACCTCTTGGGCTCGGATTATGTATTCCCACGCACAGCAAACAAGATTATTAAGGCATACCTCAAATACCTCGGCGTGTTGTAGTAGTGAAGAATACACCCATG
ATTCTTCGCAAAGATGGAGAACATCCGAGCGTAATACATAAGGGTCGTCGTCGTCTAATAATTCCGTAGGCTTGTAATTCCGTAGGCTTCTAATTACCGTAAGAATCATCCACTTCTTATGTGGGGTAC
         610       620       630       640       650       660       670       680       690       700       710       720

G  H  T  D  Y  S  S  V  I  N  K  I  K  A  A  K  P  D  V  V  F  N  T  L  A  G  D  S  N  V  A  F  F  K  Q  L  K  D  A  G
TGGTCACACTGACTATAGTTCTGTCATTAATAAATCAAAGCCGAAAGCCGAAAGCCAGACGTCGTATTTAACACTCTGGCGGGGATAGTAGCCTTTTTCAAGCAATTAAAGGATGCCGG
ACCAGTGTGACTGATATCAAGACAGTAATATTTAGTTTCGGCGTTCGGTCTGCAGCATAAATTGTGAGACCGCGCCCATCATTACATCGGAAAAAGTTCGTTAATTCCTACGGCC
         730       740       750       760       770       780       790       800       810       820       830       840

I  D  A  N  T  L  P  V  M  S  V  S  I  A  E  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGGAGATCAAAGGCATTGGTCCAGATGTATTTAAAAGGTCATCTGTCACATGAACTATTTCCAAAGTGTAGA
CTAACTGCGTTATGTGAGGGACAGTACTCGCACTGTAGCGGCTCCTCCTCCTAGTTTCCGTAACCAGTCTCATAAATTTCCAGTAGACCGTCATGGTGGACATGTATCCAGTCACATCT
         850       860       870       880       890       900       910       920       930       940       950       960
```

```
          270                        280                        290                        300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAACAAGGAGTTCGTTGAGAAGAGTTCGTTGAGAATATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTCATAGCCCTCCTGGCCCACTGTCTACTGGGTTAGCTCCGCGTATGGCCGCATATGAATACCCGATTTCGCCAACT
     970        980        990        1000        1010        1020        1030        1040        1050        1060        1070        1080
          310                        320                        330                        340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAAGGGCATCGAATTTAACGCCCAGTAGGGCCCAGTAAAGATTGACGGCGACAACCAGCACCTCTACAAGACGGTGCG
CTTCCGCCCAGCTGTCTGCACCTATTCCAGGCCCTCCGGCGCTTCCCGTAGCTTAAATTGCGGGGTCTCATTTCTAACTGCCGCTGTTGGTCGTGGAGATGTTCTGCCACGC
     1090        1100        1110        1120        1130        1140        1150        1160        1170        1180        1190        1200
          350                        360                        370                        380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAAACAAACAAGATCCATATTTAAAAGTTATGAATGGGCACAGGGGGTTAAGCGAGCAAGGTGG
ATAACCACTCTAGGACCTCTGCCAGTTGAAGCACTCAACACCTTTTGTTTATTTGTCTAGTGTACTTAACCCGTGTCCCCAATTCGCTCGTTCCACC
     1210        1220        1230        1240        1250        1260        1270        1280        1290        1300        1310        1320
          390
S  H  H  H  H  H  *  *
TTCACATCATCATCATCATCATTAATGAAAGCGGCGATATCCAGCACACTGGGCGTGCTCTAACAGTGGATCCGGCTGCTAACAAGCCCGAAAGGAAGCTGAGTTGGCTGCTGCCACCGCT
AAGTGTAGTAGTAGTAGTAGTAATTACTTCCCGTAGCTATAGGTCGTGTGACCGGCCAATGATCACCTAGGCCGACGATTGTTTCGGGCTTTCCTTCGACTCAACCGACGACGGTGCCGA
     1330        1340        1350        1360        1370        1380        1390        1400        1410        1420        1430        1440

GAGCAATAACTAGCATAACCCCTTGGGCGCTCTAAACGGGTCTTTGAGGGGTTTTTTGCTGAAAGAGGAACTATATCCGGAGGCGACTCCCACGGCACGTTG
CTCGTTATTGATCGTATTGGGGAACCCCGAGAATTGCCCAGAACTCCCAAAAAACGACTTTCCTCGTTGATATAGGCCTCGCTGAGGGTGCCGTGCAAC
     1450        1460        1470        1480        1490        1500        1510        1520        1530        1540
```

FIG. 87 (Continued)

FIG. 88 - Exemplary Expression Construct for csUBP7_186C.29

```
CGCTTGGGACTGCCATAGCCTGGCCCGGTGATGCCGGCCACGATGATCGAGATCTCGATCCCGCGTAGAGATGCGAAATTAATACAGACTCACTATAGGGAGAACAAACGGTTTC
GCGAACCCTGATCCGACCGGGCACACGGCTGCTACACGCCGGTCCATCCTAGCTCTCCTAGCGTCCATGCAGGCCGCCTTTAATTATGCTGAGTGATATCCCTGGTGTTGCCAAAG
        10        20        30        40        50        60        70        80        90       100       110       120
```

(Note: The sequence data shown is a partial representation. The full figure contains a DNA/protein sequence alignment spanning 960 base pairs with corresponding amino acid translation showing the expression construct for csUBP7_186C.29)

```
        T  P  E  N  K  E  F  V  E  K  Y  K  K  Y  G  E  D  R  V  T  D  D  P  I  E  A  A  Y  I  G  V  Y  L  W  A  K  A  V  E
      TACACCGGAAAACAAGGAGTTCGTTGAGAAGTATAAGAAAAAGTATGGGGAGGACCGGGTGACAGATGACCAATCGAGGCGGCATAACATCGGCGTATACTTATGGGCTAAAGCGGTTGA
      ATGTGGCCTTTGTTCCTCAAGCAACTCTTTATATTCTTTTTCATAACCCCTCCTGGCCCACTGTCTACTGGGTTAGCTCCGCCGTATGTAGCCGCATATGAATACCCGATTTCGCCAACT
           970        980        990       1000       1010       1020       1030       1040       1050       1060       1070       1080

K  A  G  S  T  D  V  D  K  V  R  E  A  A  K  G  I  E  F  N  A  P  E  G  P  V  K  I  D  G  D  N  Q  H  L  Y  K  T  V  R
      GAAGGCGGGGTCGACAGACGTGGATAAGGTCCGGGAGGCCGCGAAGGGCATCGAATTTAACGCCCCAGAGGGCCCAGTGAAGATTGACGGCGACAACCAGCACCTCTACAAGACGGTGCG
      CTTCCGCCCCAGCTGTCTGCACCTATTCCAGGCCCTCCGGCGCTTCCCGTAGCTTAAATTGCGGGGTCTCATTTCTAACTGCCGCTGTTGGTCGTGGAGATGTTCTGCCACGC
           1090       1100       1110       1120       1130       1140       1150       1160       1170       1180       1190       1200

I  G  E  I  L  E  N  G  Q  I  R  E  L  W  K  T  N  K  P  V  K  P  D  P  Y  L  K  G  Y  E  W  A  Q  G  L  S  E  Q  G  G
      TATTGGTGAGATCCTCGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
      ATAACCACTCTAGGACCTCTTGCCAGTTTAAGCACTCAACACCTTTTGTTATTTGGTCTAGTGATCAATTTGGTATAAATTTCCAATACTTACCCGTGTCCCAATTCGCTCGTTCCACC
           1210       1220       1230       1240       1250       1260       1270       1280       1290       1300       1310       1320

S  H  H  H  H  H  *  *
      TTCACATCATCATCATCATCATTAATGAAAGGGCGATATCCAGCACACTGGGCCGCTGCCTACTAGTGGATCCGGCTCGTAACAAAGCCCGAAAGGAAGCTGAGTTGGCTGCTGCCACCGCT
      AAGTGTAGTAGTAGTAGTAGTAATTACTTTCCCGCTATAGGTCGTGTGACCCGGCCAATGATCACCTAGGCCGACGATTGTTCGGGCTTCCTTGACTCAACCGACGACGGTGCCGA
           1330       1340       1350       1360       1370       1380       1390       1400       1410       1420       1430       1440

GAGCAATAACTAGCATAACCCCTTGGGCCTCTAAACGGGTCTTTTTTGCTGAAAGGAGGAACTATATCCGGAGCGACTCCCACGGCACGTTG
      CTCGTTATTGATCGTATTGGGAACCCCGGAGATTTGCCCAGAAACGACTTTCCTCCTTGATATAGGCCTCGCTGAGGGTGCCGTGCAAC
           1450       1460       1470       1480       1490       1500       1510       1520       1530       1540
```

FIG. 88 (Continued)

FIG. 89 - Exemplary Expression Construct for csUBP7_18GC.30

```
CGCTTGGGACTGCCATAGCCTGGCCCGGTGATGCCGGCCACGATGCTCGATCGAGATCGAGATCTCGATCCCGCGGTAGAGGATTAATACGACTCACTATAGGGAGACCACAACGGTTTC
GCGAACCCTGATCCGACGGTATCCGACGGGCCACTACGGCCGGTGCTACCAGGCCATCCTCTAGCTCTAGAGCTAGGGCGCTTTAATTATGCTGAGTGATATCCCTCGTGTTGCCAAAG
         10         20        30        40        50         60        70        80        90       100        110      120
                                                                        M  S  S  S  E  K  E  K  S  E  E  T  I  K  V  G  I  L  H  S  L  S  G  T
CCTCTAGAAATAATTTTGTTAACTTTAAGAAGGAGATATACCATGAGTTCATCAGAATCAGAAAAAGAAAAGAAGAGACCATCAAAGTAGGAGATTCTCCACAGCTTGAGTGGTAC
GGAGATCTTTATTAAAACAATTGAAATTCTTCCTCTATATGGTACTCAAGTAGTCTTAGTCTTTTTCTTTTCTCTGTAGTTCATCCTAAGACGTGTCGAACTCACCATG
        130        140       150       160       170        180       190       200       210       220        230      240
M  S  I  S  E  V  S  L  K  D  A  E  L  M  A  I  E  E  I  N  N  N  G  V  L  G  K  K  L  E  P  I  V  E  D  G  A  S  D
GATGTCAATCTCAGAGTTTCCTTAAAGATGCCGAATTAATGGCGATCGAAGAGATCAACAATAATGGCGGTGTGTTAGGTAAAAAGTTAGAACCGATCGTGGAAGATGGCGCCTCAGA
CTACAGTTAGAGTCTCAAAGGAATTTCTACGGCTTAATTACCGCTAGCTTCTTCTAGTTGTTATTACCGCCACAATCATTTTCAATCTTGGCTAGCACCTTCTACCGCGGAGTCT
        250        260       270       280       290        300       310       320       330       340        350      360
W  P  T  F  A  E  K  K  K  L  L  Q  K  D  K  V  A  V  I  F  G  A  W  T  S  A  S  R  K  A  V  L  P  V  V  E  E  N  N
CTGGCCGACCTTCGCTGAAAAGGCTAAGAAACTTTTACAGAAGGACAAAGTTGGCAGTAATTTTCGGCGCTTGACCTGCCAAAGCCGCAACCTCGGCTACTCGTCGAAGAAAATAA
GACCGGCTGAAGCGACTTTCCGATTCTTTGAAAATGTCTTCCTGTTCATTAAAAAGCGCGAACCTGGAGCCGTTCAGCGTTCGGCATGAGAGGTCAGCAGCTTCTTTTATT
        370        380       390       400       410        420       430       440       450       460        470      480
G  L  L  F  Y  P  V  Q  Y  E  G  L  E  S  S  P  N  I  F  Y  M  G  A  A  P  N  Q  Q  I  V  P  A  V  K  W  L  F  D  N  G
TGGGCTTCTCTCTATCCGGTTCAGTATGAAGGTCTCGAAAGTTCCCAAATATCTTTTACATGGGCGCCGCCCCAAACCAGCAGATCGTGCCAGCAGTTAAATGGCTCTTCGACAACGG
ACCCGAAGAGAAGATAGGCCAAGTCATACTTCCAGAGCTTTCAAGGGGTTTAAGAAATGTACCCGCGGCGGGTTTGGTCGTCTAGCACGGTCGTCAATTTACCGAGAAGCTGTTGCC
        490        500       510       520       530        540       550       560       570       580        590      600
K  K  R  F  Y  L  L  G  S  D  Y  Y  V  F  P  R  T  A  N  K  I  H  K  A  Y  L  K  Y  L  G  G  V  V  V  G  E  E  Y  T  P  C
TAAGAAGCGTTTCTACCTCTTGGGCTCGGATTATGTATTCCCACGCACAGCACAAGATTATTAAGGCATACTCAAATACCTCGGCGGTGTTGTAGTAGGTGAAGAATACACCCCATG
ATTCTTCGCAAAGATGGAGACATAGGGCTGAGCCTAATACATATAAGGGTGCGTGTCGTTGCTGTCGTATCAATAATTCCGAATGGAGTTTATGGAGCCGCCACAACATCATCCACTTCTATGTGGGGTAC
        610        620       630       640       650        660       670       680       690       700        710      720
G  H  T  D  Y  S  S  V  I  N  K  I  K  A  A  K  P  D  V  V  F  N  T  L  S  G  D  S  N  V  A  F  F  K  Q  L  K  D  A  G
TGGTCACACTGACTATAGTTCTGTCATTAATAAAATCAAAGCCGCAAAGCCCGATGTCGTATTTAACACTCTGAGCGGGGATAGTAACCGAAGACCTTTTTCAAGCAATTAAAGGATGCCGG
ACCAGTGTGACTGATATCAAGACAGTAGTTAGTTATTTTAGTTTCGGCGGTTTCGGCTGCAGCATAAGAATCGTGAGACTCGCAGCATTACATCGGAAAAAGTTCGTTAATTTCCTACGGCC
        730        740       750       760       770        780       790       800       810       820        830      840
I  D  A  N  T  L  P  V  M  S  V  S  I  A  E  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGATCAAAGGCATTGGTCCAGAGTATTTAAAAGGTCATCTGTCACATGAACTATTTCAAAGTGTAGA
CTAACTGCGTTATGTGAGGGACAGTACTCGCACCTCGTAGCGCGTCCGTACAAGTCTCCTCCTCTAGTTTCCGTAACCAGTCTCATAAATTTCCAGTAGACCAGTTGATAAAGGTTCACATCT
        850        860       870       880       890        900       910       920       930       940        950      960
```

```
                              270                            280                           290                            300
     T  P  E  N  K  E  F  V  E  K  Y  K  K  K  Y  G  E  D  R  V  T  D  D  P  I  E  A  A  Y  I  G  V  Y  L  W  A  K  A  V  E
     TACACCGGAAAACAAGGAGTTCGTTGAGAAGTATAAGAAAAAGTATGGGGAGGACCGGGTGACAGATGACCAATCGAGGCGGCATACATCGGCGTATACTTATGGGCTAAAGCGGTTGA
     ATGTGGCCTTTGTTCCTCAAGCAACTCTTTATATTCTTTTTCATATCCCCTCCTGGCCCACTGTCTACTGGGTTAGCTCCGCCGTATGTAGCCGCATATGAATACCCGATTTCGCCAACT
              970            980            990           1000           1010           1020           1030           1040           1050           1060           1070           1080

310                           320                           330                            340
     K  A  G  S  T  D  V  D  K  V  R  E  A  A  K  G  I  E  F  N  A  P  E  G  P  V  K  I  D  G  D  N  Q  H  L  Y  K  T  V  R
     GAAGGCGGGGTCGACAGACGTGGATAAGGTCCGGGAGGCCGCGAAGGGCATCGAATTTAACGCCCAGAGGGCCCAGTAAAGATTGACGGCGACAACCAGCTCTACAAGACGGTGCG
     CTTCCGCCCCAGCTGTCTGCACCTATTCCAGGCCCTCCGGCGCTTCCCGTAGCTTAAATTGCGGGGTCTCATTTCTAACTGCCGCTGTTGGTCGTGGAGATGTTCTGCCACGC
             1090           1100           1110           1120           1130           1140           1150           1160           1170           1180           1190           1200

350                           360                            370                            380
     I  G  E  I  L  E  N  G  Q  I  R  E  L  W  K  T  N  K  P  V  K  P  D  P  Y  L  K  G  Y  E  W  A  Q  G  L  S  E  Q  G  G
     TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
     ATAACCACTCTAGGACCTCTTGCCATTTAAGCACTCAACACCTTTGTTATTTGGTCTAGTGTCAATTTCCAATACTTACCCGTGTCCCAATTCGCTCGTTCCACC
             1210           1220           1230           1240           1250           1260           1270           1280           1290           1300           1310           1320

390
     S  H  H  H  H  H  *  *
     TTCACATCATCATCATCATCATTAATGAAAGGGCGATATCCAGCACACTGGGCGTCCGGCTGCTAACAGTCGACCAGCTGAAAGGAAGCTGAGTTGGCTGCTGCCACCGCT
     AAGTGTAGTAGTAGTAGTAGTAATTACTTTCCCGCTATAGGTCGTGTGACCCGCCAATGATCAACCTAGGCCGACGATTGTTTCGGGCTTTCCTTCGACTCAACCGACGGTGCCGA
             1330           1340           1350           1360           1370           1380           1390           1400           1410           1420           1430           1440

GAGCAATAACTAGCATAACCCCTTGGGCCTCTAAACGGGTCTTTGAGGGGTTTTTTGCTGAAAGGAGGAACTATATCCGGAGGACTCCCACGGCACGTTG
     CTCGTTATTGATCGTATTGGGGAACCCGAGAATTGCCCAGAAACGACTTTCCTCCTTGATATAGGCCTCGCTGAGGGTGCCGTGCAAC
             1450           1460           1470           1480           1490           1500           1510           1520           1530           1540

FIG. 89 (Continued)
```

FIG. 90 - Exemplary Expression Construct for csUBP7_186C.31

```
          270                    280                    290                    300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAAACAAGGAGTTCGTTGAGAAATATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTCATATCCCTCCTGGGTTAGCTCCGCCGCATATGAATACCCGATTTCGCCAACT
           980                    1000                   1020                   1040                   1060                   1080
```

```
          310                    320                    330                    340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCCAGAGGGCCCAGTAAAGATTGACGGCGACAACCAGCACCTCTACAAGACGGTGCG
CTTCCGCCCCAGCTGTCTGCACCTATTCCAGGCGCTTCCCGGTTCCCGGTCTAAATTGCGGGTCTAAATTGCGGGTCATTTCTAACTGCCGCTGTTGGTCGTGGAGATGTTCTGCCACGC
          1090                   1110                   1130                   1150                   1170                   1190                   1200
```

```
          350                    360                    370                    380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAAAGTTATGAATGGGCACAGGGGTTAAGCGAGCAAGGTGG
ATAACCACTCTAGGACCTCTGCCAGTTAAGCACTCAACACCTTTGTTATTTGTCTAGTTATAAATTTTCCAATACTTACCCGTGTCCCCAATTCGCTCGTTCCACC
          1210                   1230                   1250                   1270                   1290                   1310                   1320
```

```
          390
S  H  H  H  H  H  *  *
TTCACATCATCATCATCATCATTAATGAAAGGGCGATATCCAGCACACTGGCGCTGCTGCTTACTAGTGGATCCGGCTGCTAACAAAGCCCGAAAGGAAGCTGAGTTGGCTGCTGCCACCGCT
AAGTGTAGTAGTAGTAGTAGTAATTACTTTCCCCGCTATAGGTCGTGTGACCGCCAATGATCAACCTAGGCCGACGATTGTTTCGGGCTTTCCTTCGACTCAACCGACGACGGTGCCGA
          1330                   1350                   1370                   1390                   1410                   1430                   1440
```

```
GAGCAATAACTAGCATAACCCCTTGGGCCTCTAAACGGGTCTTTTTGCTGAAAGAGGAACTATATCCGGAGCGACTCCCACGGCACGTTG
CTCGTTATTGATCGTATTGGGAGAACCCCGAGATTGCCCAGAAACGACTTTCCTCCTTGATATAGGCCTCGCTGAGGGTGCCGCTGCAAC
          1450                   1470                   1490                   1510                   1530                   1540
```

FIG. 90 (Continued)

FIG. 91 - Exemplary Expression Construct for csUBP7_18GC.32

```
            270                         280                         290                         300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAAACAAGGAGTTCGTTGAAGAAGTAGAAATATAAGAAAAAGTATGGGGAGGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTTCATATCCCTCCTGGCCCACTGTCTACTGGGTTAGCTCCGCCTATGTAGCCGCATATGAATACCCGATTTCGCCAACT
      970         980         990         1000         1010         1020         1030         1040         1050         1060         1070         1080
     310                         320                         330                         340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCCAGAGGGCCCAGTAAAGATTGACGGCGACAACCAGCACCTCTACAAGACGGTGCG
CTTCCGCCCCAGCTGTCTGCACCTATTCGAGGCCCTCTGCACCCTATTCCAGGCGCGCTTCCCGTAGCTTAAATTGCGGGGTCTCCCGGGTCATTTCTAACTGCCGCTGTTGGTCGTGGAGATGTTCTGCCACGC
      1090         1100         1110         1120         1130         1140         1150         1160         1170         1180         1190         1200
     350                         360                         370                         380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCCTCTGCCAGTTGAAGCACTCAACACCTTTGTTATTTGTCTAGTGATATAAATTTTCCAATACTTACCCCGTCCCCAATTCGCTCGTTCCACC
      1210         1220         1230         1240         1250         1260         1270         1280         1290         1300         1310         1320
     390
S  H  H  H  H  H  *  *
TTCACATCATCATCATCATCATTAATGAAAGGGCGATATCCAGCACACTGGCCGTTACTAGTGGATCCGGCTGCTAACAAAGCCCGAAAGGAAGCTAGTTGCTGCTGCCACCGCT
AAGTGTAGTAGTAGTAGTAGTAATTACTTTCCCGCTATAGGTCGTGTGACCGGCCAATGATCACCTAGCCGACGATTGTTTCGGGCTTTCCTTCGACTCAACCGACGACGGTGCCGA
      1330         1340         1350         1360         1370         1380         1390         1400         1410         1420         1430         1440

GAGCAATAACTAGCATAACCCCTTGGGCCTCTAAACGGGTCTTGAGGGGTTTTTTGCTGAAAGAGGAACTATATCCGGAGGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGCGTGCAAC
      1450         1460         1470         1480         1490         1500         1510         1520         1530         1540
```

FIG. 91 (Continued)

FIG. 92 - Exemplary Expression Construct for csUBP7_186C.33

```
CGCTTGGGACTGCCATAGCTGGCCCGGTGATGCCGGCCACGATGCTCGATCGAGATCTCGATCCCGCGGTAGAGATCGAGAATTAATACAGACTCACTATAGGGAGACCACAACGGTTTC
GCGAACCCTGATCCGACGGGTATCCGACGGCCGGTGCTACGGCCGGTGCTACGACCCGGTGCCATGCCGGTGCCATCTCCTAGCTCTAGCTGGCGCCTTTAATTATGCTGAGTGATATCCCTCTGGTTGCCAAAG
        10         20         30         40         50         60         70         80         90        100        110        120
                                                                                             M  S  S  S  E  K  R  S  E  E  T  I  K  V  G  I  L  H  S  L  G  T
CCTCTAGAAATAATTTTGTTAACTTTAAGAAGGAGATATACCATGAGTTCATCAGAATCAGAAAAGAGAATGAAGAGACCATCAAAGTAGAAGGATTCTCCACAGCTTGAGTGGTAC
GGAGATCTTATTAAAACAATTGAAATTCTTCCTCATAGTATTAGTCTTCAAGTAGTCTTAGTCTTTTCTTTTCACTTCTCTGGTAGTTCATCCTAAGACAGTGTCGAACTCACCATG
       130        140        150        160        170        180        190        200        210        220        230        240
   M  S  I  S  E  V  S  L  K  D  A  E  L  M  A  I  E  E  I  N  N  N  G  V  L  G  K  K  L  E  P  I  V  E  D  G  A  S  D
GATGTCAATCTCAGAGTTCTAAAAGATGCCGAATTAATGGCCATCGAAGAGATCAACAACAATGGCGGTGTGTTAGGTAAAAAGTTAGAACCGATCGTGGAAGATGGCGCCTCAGA
CTACAGTTAGAGTCTCAAGATTTCTACGGCTTAATTACCGGTAGTACTTCTTCTAGTTGTTGTATTACCGCCACACAATCATTTTCAATCTTGGCTAGCACCTTCTACCGCGGAGTCT
       250        260        270        280        290        300        310        320        330        340        350        360
   W  P  T  F  A  E  K  A  K  K  L  L  Q  K  D  K  V  A  V  I  F  G  A  W  T  S  A  S  R  K  A  V  L  P  V  V  E  E  N  N
CTGGCCCGACCTTCGCTGAAAAGGCTAAGAAACTTTTACAGAAGGACAAAGTTGGCAGTAATTTTCGGCGCTTGACCTGACCGCAAGCTCGCAAAGTCGTCGAAGAAATAA
GACCGGCTGAAGCGACTTTCCGATTCTTTGAAATGTCTTCCTGTTCCATTAAAAGCCGCGAACCTGGAACCTGGAGCCGTTCAGCGTTTCAGCATGAGAGGTCAGCAGCTTCTTTTATT
       370        380        390        400        410        420        430        440        450        460        470        480
     G  L  L  F  Y  P  V  Q  Y  E  G  L  E  S  S  P  N  I  F  Y  M  G  A  A  P  N  Q  Q  I  V  P  A  V  K  W  L  F  D  N  G
TGGGCTTCTCTATCCGGTTCAGTATGAAGGTCTCGAAAGTTCCCAAATATCTTTACATGGGCGCCGCCCCAAACCAGCAGATCGTGCCAGCAGTTAAATGGCTCTTCGACAACGG
ACCCGAAGAGATAGGCCAAGTCATACTTCCAGAGCTTTCATAGAAATGTACCCGCGGCGGTTGTCGTCTAGCAGGTCGTCAATTTACCGAGAAGCTGTTGCC
       490        500        510        520        530        540        550        560        570        580        590        600
       K  K  R  F  Y  L  L  G  S  D  Y  Y  F  P  R  T  A  N  K  I  I  K  A  Y  L  K  Y  L  G  G  V  V  V  G  E  E  Y  T  P  C
TAAGAAGCGTTTCTACCTCTTGGGCTCGGATTATGTATTCCCACGCACAGCACAAGATTATTAAGGCATACTTGGCGGTGTTGTAGTAGGTGAAGAATACACCCCATG
ATTCTTCGCAAAGATGGAGAAGTAGGCCAAGTCATAACATACATAAGGGCGTGCGTTGCTAATAATTCCGATGAGTTATGGAGCCGCCACAACATCATCCACTTCTATGTGGGGTAC
       610        620        630        640        650        660        670        680        690        700        710        720
   G  H  T  D  Y  S  S  V  I  N  K  I  K  A  A  K  P  D  V  V  F  N  T  L  H  G  D  S  N  V  A  F  F  K  Q  L  K  D  A  G
TGGTCACACTGACTATAGTTCTGTCATTAATAAATCAAAGCCCGATGGTCGTATTTAACACTCTGCATGGGGATAGTAGCCTTTTTCAAGCAATTAAAGGATGCCGG
ACCAGTGTGACTGATATCAAGACAGTATTATTTTAGTTTCGGCGTTCGCAGCATAAATTGTGAGACGTCGCCTATCATCATTACATCGGAAAAAGTTCGTTAATTTCCTACGGCC
       730        740        750        760        770        780        790        800        810        820        830        840
         I  D  A  N  T  L  P  V  M  S  V  S  I  A  E  E  I  K  G  I  G  P  E  Y  L  K  G  H  L  V  T  W  N  Y  F  Q  S  V  D
GATTGACGCAAATACACTCCCTGTCATGAGCGTGAGCATCGCCGAGGAGAATCAAAGGCATTGGTCCAGATGTATTTAAAAGTCATCTGTCACATGTACGAACTATTCCAAAGTGTAGA
CTAACTGCGTTATGTGAGGGACAGTACTCCGCACTCGTAGCGCGGCCTCCTAGTTTCCGTAACCAGTCTCATAAATTTCCAGTAGACCCAGTGTACCCAGTGATCAATGTTCACATCT
       850        860        870        880        890        900        910        920        930        940        950        960
```

```
                          270                             280                            290                          300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAAACAAGGAGTTCGTTGAGAAGTATAAGAAAAAGTATGGGGAGGACCGGGTGACAGATGACCCAATCGAGGCGGCATAACATCGGCGTATACTTATGGGCTAAAGCGGTTGA
ATGTGGCCTTTGTTCCTCAAGCAACTCTTTATATTCTTTTTCATATCCCCTCCTGGCCCACTGTCTACTGGGTTAGCTCCGCCTATGTAGCCGCATATGAATACCCGATTTCGCCAACT
    970            980            990           1000           1010           1020           1030           1040           1050           1060           1070           1080

310                             320                              330                          340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAGGGCATCGAATTTAACGCCCAGTAAAGATTGACGGCGACAACCAGCACCTCTACAAGACGGTGCG
CTTCCGCCCCAGCTGTCTGCACCTATTCCAGGCGCTTCCCGGCGCCCTATTCCAGGCGCTTCCCGGTCTCATTTCTAACTGCCGCTGTTGGTCGTGGAGATGTTCTGCCACGC
    1090           1100           1110           1120           1130           1140           1150           1160           1170           1180           1190           1200

350                             360                              370                          380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAAAGTTATGAATGGGCACAGGGGTTAAGCGAGCAAGGTGG
ATAACCACTCTAGGACCTCTGCCAGTTAAGCACTCAACACCTTTGTTATTTATTTGTCTAGTGATATAAATTTCCAATACTTACCCGTGTCCCCAATTCGCTCGTTCCACC
    1210           1220           1230           1240           1250           1260           1270           1280           1290           1300           1310           1320

390
S  H  H  H  H  H  *  *
TTCACATCATCATCATCATCATTAATGAAAGGGCGATATCCAGCACACTGGCGTCGGCCGTTACTAGTGGATCCGGCTGCTAACAAAGCCCGAAAGGAAGCTGAGTTGGCTGCTGCCACCGCT
AAGTGTAGTAGTAGTAGTAGTAATTACTTTCCCGGTTAAGGGCGATATCCAGCACACTGGCGTCGGCCGTTACTAGTGGATCCGGCTGCTAACAAAGCCCGAAAGGAAGCTGAGTTGGCTGCTGCCACCGCT
    1330           1340           1350           1360           1370           1380           1390           1400           1410           1420           1430           1440

GAGCAATAACTAGCATAACCCCTTGGGCCTCTAAACGGGTCTTTGAGGGGTTTTTTGCTGAAGAGGAACTATATCCGGAGGCGACTCCCACGGCACGTTG
CTCGTTATTGATCGTATTGGGGAACCCCGAGAATTGCCCAGAAACGACTTTCCTCCTTGATATAGGCCTCGCTGAGGGTGCCGCGTGCAAC
    1450           1460           1470           1480           1490           1500           1510           1520           1530           1540
```

FIG. 92 (Continued)

FIG. 93 - Exemplary Expression Construct for csUBP7_18GC.34

```
CGCTTGGGACTGCCATAGCCTGGCCCGGTGATGCCGGCCACGATGCTCGATCCGCGTAGAGGATCGAGATCTCGATCCGCGAAATTAATACGACTCACTATAGGGAGACCACAACGGTTTC
GCGAACCCTGATCCGACGGTATCCGGGCCACTACGGCCGTGCTACCAGCCGCATCCTAGCTCCTAGCTAGGGCGCTTAATTATGCTGAGTGATATCCCTCGTGTTGCCAAAG
         10        20        30        40        50        60        70        80        90       100       110       120

M   S   S   S   E   K   S   E   E   T   I   K   V   G   I   L   H   S   L   S   G   T
CCTCTAGAAATAATTTGTGTTAACTTTAAGAAGGAGATATACCATGAGTTCATCAGAATCAGAAAAAAGTGAAGACCATCAAAGTAGGGATTCTCCACAGCTTGAGTGGTAC
GGAGATCTTTATTAAAACAATTGAAATTCTTCCTCATATATGGTACTCAAGTAGTCTTAGTCTTTTCTTTTTCACTTCTCTGGTAGTTCATCCTAAGAGTGTCGAACTCACCATG
        130       140       150       160       170       180       190       200       210       220       230       240

M   S   I   S   E   V   S   L   K   D   A   E   L   M   A   I   E   E   I   N   N   N   G   V   L   G   K   K   L   E   P   I   V   E   D   G   A   S   D
GATGTCAATCTCAGAAGTTCCTTAAAGATGCCGAATTAATGGCCATCGAAGAGATCAACAACAATGGCGGTGTTAGGTAAAAAGTTAGAACCGATCGTGGAAGATGGCGCCTCAGA
CTACAGTTAGAGTCTTCAAGGAATTTCTACGGCTTAATTACCGGTAGTTCTCGTAGTTGTTATTACCGCCACACAATCCATTTTTCAATCTTGGCTAGCACCTTCTACCGCGGAGTCT
        250       260       270       280       290       300       310       320       330       340       350       360

W   P   T   F   A   E   K   A   K   K   L   L   Q   K   D   K   V   A   V   I   F   G   A   W   T   S   A   S   R   K   A   V   L   P   V   V   E   E   N   N
CTGGCCGACCTTCGCTGAAAAGGCTAAGAAACTTTTACAGAAGGACAAGGTGGCAGTGATTTTCGGCGCTTGGACCTCGGCAAGTCGGCAAAGCCGTACTCCCAGTCGTCGAAGAAATAA
GACCGGCTGAAGCGACTTTTCCGATTCTTTGAAAATGTCTTCCTGTTCCACGCGTCACTAAAAGCCGCGAACCTGGAGCCGTTCAGCGTTTCGGCATGAGAGGTCAGCAGCTTCTTTATT
        370       380       390       400       410       420       430       440       450       460       470       480

G   L   L   F   Y   P   V   Q   Y   E   G   L   E   S   S   P   N   I   F   Y   M   G   A   A   P   N   Q   Q   I   V   P   A   V   K   W   L   F   D   N   G
TGGGCTTCTCTTCTATCCGGTTCAGTATGAAGGTCTCGAGAGCTCGCCAAATATCTTTTACATGGGCGCCGCCCCAAACCAGCAGATCGTGCCAGCAGTTAAATGGCTCTTCGACAACGG
ACCCGAAGAGAATAGGCCAAGTCATACTTCCAGACTCGAGACGAGGCTTAGAAGCCAGAGCTCTGTCGTAGCACGGTCGTCAATTTACCGAGAAGCTGTTGCC
        490       500       510       520       530       540       550       560       570       580       590       600

K   K   R   F   Y   L   L   G   S   D   Y   V   F   P   R   T   A   N   K   I   H   K   A   Y   L   K   Y   L   G   G   V   V   V   G   E   E   Y   T   P   C
TAAGAAGCGTTTCTACCTCTTGGGCTCGGATTATGTATTCCCACGCACAGCAGACAAACAAGATTATTAAGGCATACCTCAAATACCTCGGCGGTGTTGTAGTAGGTGAAGAATACACCCCATG
ATTCTTCGCAAAGATGGAGATAGGCCAGACCCGAGCCTAATACATAAGGGTGCGTGTCGTGTCGTTCGTCTTGTCTCAATAATTCCGTATGAGTTTATGAGCCGCCACAACATCATCCACTTCTTATGTGGGGTAC
        610       620       630       640       650       660       670       680       690       700       710       720

G   H   T   D   Y   S   S   V   I   N   K   I   K   A   A   K   P   D   V   V   F   N   T   L   T   G   D   S   N   V   A   F   F   K   Q   L   K   D   A   G
TGGTCACACTGACTATAGTTCTGTCATTAATAAATCAAAGCCGCAAAGCCGAAATCAAAGCCGCAAAGCCGGATGTCGTATTTAACACTCTGACACTCTGACCGGGGATAGTAGCCTTTTTCAAGCAATTAAAGGATGCCGG
ACCAGTGTGACTGATATCAAGACAGTAATTATTTTAGTTTCGGCGTTTCGGCGTTCGGCTTTAGGCCGCAGCGTCGACAGCATAAATTGTGAGACTGTGAGACTGTGAGACTACATCATCAAATCAAATCGGAAAAAGTTCGTTAATTCCTACGGCC
        730       740       750       760       770       780       790       800       810       820       830       840

I   D   A   N   T   L   P   V   M   S   V   S   I   A   E   E   I   K   G   I   G   P   E   Y   L   K   G   H   L   V   T   W   N   Y   F   Q   S   V   D
GATTGACGCAAATACACTCCCTGTCATGAGCGTGAGCATCGCCGAGGAGGAGATCAAAGGCATTGGTCCAGAGTATTTAAAAGGTCATCTGTCACATGAACTATTCCAAAGTGTAGA
CTAACTGCGTTTATGTGAGGGACAGTACTCCGCACTGTAGCGGCCTCCTCCTCTAGTTTCCGTAACCAGTCTCATAAATTTCCAGTAGACCAGTGTACCCAGGTACCTTGATAAAGGTTTCACATCT
        850       860       870       880       890       900       910       920       930       940       950       960
```

```
          270                      280                      290                      300
T  P  E  N  K  E  F  V  E  K  Y  K  K  K  Y  G  E  D  R  V  T  D  D  P  I  E  A  A  Y  I  G  V  Y  L  W  A  K  A  V  E
TACACCGGAAACAAGGAGTTCGTTGAGAAGTATAAGAAAAAGTATGGGGAGGACCGGGTGACAGATGACCAATCGAGGCGGCATAACATCGGCGTATACTTATGGGCTAAAGCGGTTGA
ATGTGGCCTTTGTTCCTCAAGCAACTCTTTATATTCTTTTCATAACCCCTCCTGGCCCACTGTCTACTGGGTTAGCTCCGCCGTATGTAGCCGCATATGAATACCCGATTTCGCCAACT
         980                990               1000              1010              1020              1030              1040              1050              1060              1070              1080

310                      320                      330                      340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGTCGACAGACGTGGATAAGGTCCGGGAGGCCGCGAAAGGGCATCGAATTTAACGCCCAGAGGGCCCAGTAAAGATTGACGGCGACAACCAGCACCTCTACAAGACGGTGCG
CTTCCGCCCAGCTGTCTGCACCTATTCCAGGCCCTCCGGCGCTTCCCGGAGCTTAAATTGCGGGTCTCATTTCTAACTGCCGCTGTTGGTCGTGGAGATGTTCTGCCACGC
        1090              1100              1110              1120              1130              1140              1150              1160              1170              1180              1190              1200

350                      360                      370                      380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGTTATGAATGGGCACAGGGGTTAAGCGAGCAAGGTGG
ATAACCACTCTAGGACCTCTGCCAGTTGAAGCACTCAACACCTTTGTTATTTGTCTAGTGATAAAATTTCCAATACTTACCCGTGTCCCCAATTCGCTCGTTCCACC
        1210              1220              1230              1240              1250              1260              1270              1280              1290              1300              1310              1320

390
S  H  H  H  H  H  *  *
TTCACATCATCATCATCATCATTAATGAAAGGGCGATATCCAGCACACTGGCCGTCGGCCGTTACTAGTGGATCCGGCTGCTAACAAAGCCCGAAAGGAAGCTGAGTTGCTGCTGCCACCGCT
AAGTGTAGTAGTAGTAGTAGTAATTACTTTCCCGCTATAGGTCGTGTGACCGGCCAATGATCAACCTAGGCCGACGATTGTTTCGGGCTTTCCTTCGACTCAACGACGACGGTGGCGA
        1330              1340              1350              1360              1370              1380              1390              1400              1410              1420              1430              1440

GAGCAATAACTAGCATAACCCCTTGGGCCTCTAAACGGGTCTTTTTTTGCTGAAAGAGGAACTATATCCGGAGGACTCCCACGGCACGTTG
CTCGTTATTGATCGTATTGGGGAACCCCGAGATTTGCCCAGAAACGACTTTCCTCCTTGATATAGGCCTCGCTGAGGGTGCCGCGTGCAAC
        1450              1460              1470              1480              1490              1500              1510              1520              1530              1540

FIG. 93 (Continued)
```

FIG. 94 - Exemplary Expression Construct for csUBP7_18GC.35

```
        T  P  E  N  K  E  F  V  E  K  Y  K  K  K  Y  G  E  D  R  V  T  D  D  P  I  E  A  A  Y  I  G  V  Y  L  W  A  K  A  V  E
     TACACCGGAAAACAAGGAGTTCGTTGAGAAGTATAAGAAAAAGTATGGGGAGGACCGGGTGACAGATGACCAATCGAGGCGGCATAACATCGGCGTATACTTATGGGCTAAAGCGGTTGA
     ATGTGGCCTTTGTTCCTCAAGCAACTCTTTATATTCTTTTCATAATCCCTCCTGGCCCACTGTCTACTGGGTTAGCTCCGCCGTATGTAGCCGCATATGAATACCCGATTTCGCCAACT
          970         980        990        1000       1010       1020       1030       1040       1050       1060       1070       1080
        K  A  G  S  T  D  V  D  K  V  R  E  A  A  K  G  I  E  F  N  A  P  E  G  P  V  K  I  D  G  D  N  Q  H  L  Y  K  T  V  R
     GAAGGCGGGGTCGACAGACGTGGATAAGGTCCGGGAGGCCGCGAAGGGCATCGAATTTAACGCCCAGAGGGCCCAGTAAAGATTGACGGCGACAACCAGCACCTCTACAAGACGGTGCG
     CTTCCGCCCAGCTGTCTGCACCTATTCCAGGCCCTCGGCGCTTCCCGGTCTCCCGGGTCTCATTTCTAACTGCCGCTGTTGGTCGTGGAGATGTTCTGCCACGC
          1090        1100       1110       1120       1130       1140       1150       1160       1170       1180       1190       1200
        I  G  E  I  L  E  N  G  Q  I  R  E  L  W  K  T  N  K  P  V  K  P  D  P  Y  L  K  G  Y  E  W  A  Q  G  L  S  E  Q  G  G
     TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
     ATAACCACTCTAGGACCTCTTGCCAGTTTAAGCACTCAACACCTTTGTTATTGGTCTAGTATCAATTTGTCAATTTGTCAATACTACCCGTGTCCCAATTCGCTCGTTCCACC
          1210        1220       1230       1240       1250       1260       1270       1280       1290       1300       1310       1320
        S  H  H  H  H  H  *  *
     TTCACATCATCATCATCATTAATGAAAGGGCGATATCCAGCACACTGGCGTCGGCCGTTACTAGTGGATCCGGCTGCTAACAAAGCCCGAAAGGAAGCTGAGTTGGCTGCTGCCACCGCT
     AAGTGTAGTAGTAGTAGTAGTAATTACTTTCCCGCTATAGGTCGTGTGACCCGGCCAATGATCACCTAGCCGACGATTGTTCGGGCTTTCCTTCGACTCAACCGACGACGGTGCCGA
          1330        1340       1350       1360       1370       1380       1390       1400       1410       1420       1430       1440

GAGCAATAACTAGCATAACCCCTTGGGCCTCTAAACGGGTCTTTTTTTGCTGAAAGGAGGAACTATATCCGGAGGCGACTCCCACGGCACGTTG
     CTCGTTATTGATCGTATTGGGGAACCCCGAGAATTGCCAGAAAACGACTTTCCTCCTTGATATAGGCCTCGCTGAGGGTGCCGCGCAAC
          1450        1460       1470       1480       1490       1500       1510       1520       1530       1540
```

FIG. 94 (Continued)

FIG. 95 - Exemplary Expression Construct for csUBP7_18GC.36

```
CGCTTGGGACTGCCATAGCTGGCCCGGTGATGCCGGCCACGATGCTCGATCCGGCGTAGAGAATCGAGATCGATCCCGCGAAATTAATACAGACTCACTATAGGGAGACCACAACGGTTTC
GCGAACCCTGATCCGACGGGCACTACGGCCGTTGCTACCAGCCATCCTAGCTCTAGAGCTAGGGCGCTTTAATTATGCTGAGTGATATCCCTCTGGTTGCCAAAG
         10        20        30        40        50        60        70        80        90       100       110       120

CCTCTAGAAATAATTTGTTAACTTTAAGAAGGAGATATACCATGAGTAGTTCATCAGAGAATCAGAAAAAGAGTGAAGAGACCATCAAAGTAGGGATTCTCCACAGCTTGAGTGGTAC
GGAGATCTTATTAAAACAATTGAAATTCTTCCTCTATATGGTACTCAAGTAGTCTTAGTCTTTTCTTTTCACTTCTCTGGTAGTTCATCCTAAGACGTGTCGAACTCACCATG
                                                                      M   S   S   S   E   K   K   S   E   E   T   I   K   V   G   I   L   H   S   L   G   T
                                                                                                           10                          20
        130       140       150       160       170       180       190       200       210       220       230       240

GATGTCAATCTCAGAGTTCCTTAAAGATGCCGAATTAATGGCGATCGAAGAGATCAACAATAATGGCGGTGTGTTAGGTAAAAAGTTAGAACCGATCGTGGAAGATGGCGCCTCAGA
CTACAGTTAGAGTCTCAAGGAATTTCTACGGCTTAATTACCGCTAGCTTACTTGGCTGAATTACCGCCACACAATCATTTTCAATCTTGGCTAGCACCTTCTACCGCGGAGTCT
  M   S   I   S   E   V   S   L   K   D   A   E   L   M   A   I   E   E   I   N   N   N   G   G   V   L   G   K   K   L   E   P   I   V   E   D   G   A   S   D
              30                          40                          50                          60
        250       260       270       280       290       300       310       320       330       340       350       360

CTGGCCGACCTTCGCTGAAAAGGCTAAGAAACTTTTACAGAAGAAGACCAAGGTGGCAGTAATTTTCGGCGCTTGACCTGCCAAGCCGAACCTCGGCTACTCGTCCCAGTCGTCGAAGAAATAA
GACCGGCTGGAAGCGACTTTTCCGATTCTTGAAAATGTCTTCCGATTCAATGGACGGTTCACCGTCATTAAAAGCCGCGAACTGGACGCCGTTCAGCGTTTCGGCATGAGAGGTCAGCAGCTTCTTTATT
  W   P   T   F   A   E   K   A   K   K   L   L   Q   K   D   K   V   A   V   I   F   G   A   W   T   S   A   S   R   K   A   V   L   P   V   V   E   E   N   N
          70                          80                          90                         100
        370       380       390       400       410       420       430       440       450       460       470       480

TGGGCTTCTCTTCTATCCGGTTCAGTAGTGAAGTCTCGAAAGTTCCCAAATATCTTTACATGGGCGCCGCCCCAAACCAGCAGATCGTGCCAGCAGTTAAATGGCTCTTCGACAACGG
ACCCGAAGAGAAGATAGGCCAAGTCATCACTTTCAGAGCTTTCAAGGGGTTCAAGGGTTCAAGGGTTCAAGAGATCGTCGTAGCACGGTCGTCAATTTACCGAGAAGCTGTTGCC
  G   L   L   F   Y   P   V   Q   Y   E   G   L   E   S   S   P   N   I   F   Y   M   G   A   A   P   N   Q   Q   I   V   P   A   V   K   W   L   F   D   N   G
         110                         120                         130                         140
        490       500       510       520       530       540       550       560       570       580       590       600

AAGAAGCGTTTCTACCTCTTGGGCTCTGGAGATTATGTATTCCCACGCACAGCAACAAGATTATTAAGGCATACCTCAAATACCTCGGCGGTGTTGTAGTAGGTGAAGAATACACCCCATG
TAAGAAGCGTTTCTACCTCTTGGGCTCTGGAGATTATGTATTCCCACGCACAGCAACAAGATTATTAAGGCATACCTCAAATACCTCGGCGGTGTTGTAGTAGGTGAAGAATACACCCCATG
  K   K   R   F   Y   L   L   G   S   D   Y   Y   V   F   P   R   T   A   N   K   I   I   K   A   Y   L   K   Y   L   G   G   V   V   V   G   E   E   Y   T   P   C
                         150                         160                         170                         180
        610       620       630       640       650       660       670       680       690       700       710       720

AATTCTTCGCAAAGATGGAGAACCCGAGCCTAATACAATAAGGGTGCGTGTCGTTTCGTTGTCTCAATAATTCGTATGGAGTTATGGAGCCGCCACAACATCATCCACTTCTTATGTGGGGTAC
ATTCTTCGCAAAGATGGAGAACCCGAGCCTAATACAATAAGGGTGCGTGTCGTTTCGTTGTCTCAATAATTCGTATGGAGTTATGGAGCCGCCACAACATCATCCACTTCTTATGTGGGGTAC
  G   H   T   D   Y   S   S   V   I   N   K   I   K   A   A   K   P   D   V   V   F   N   T   L   N   G   D   S   N   V   A   F   F   K   Q   L   K   D   A   G
         190                         200                         210                         220
        730       740       750       760       770       780       790       800       810       820       830       840

TGGTCACACTGACTATAGTTCTGTCATTAATAAATCAAAGCCGCAAAGCTGCGTATTAACACTCTGAACGGGATAGTAGCCTTTTCAAGCAATTAAAGGATGCCGG
ACCAGTGTGACTGATATCAAGACAGTACTTTATTTAGTTTCGGCGTTTCGGCGTTGCAGCATATACATTCATTACATCGGAAAATTGCGTTAATTCGTTACTGGCC
  I   D   A   N   T   L   P   V   M   S   V   A   I   A   E   E   I   K   G   I   G   P   E   Y   L   K   G   H   L   V   T   W   N   Y   F   Q   S   V   D
                         230                         240                         250                         260
        850       860       870       880       890       900       910       920       930       940       950       960

GATTGACGCAAATACACTCCCTGTCATGAGCCTGGCGATCGCCGAGGAGAATCAAAGGCATTGGTTCCAGAGTATTTAAAAGGTCATCTGTCACATGAACTATTCCAAAGTGTAGA
CTAACTGCGTTTATGTGAGGGACAGTACTCCGCACCGTACTTCCGTAGCAGGTCCATAAAATTTCCAGTAGACCAGTGTCATAAAATTTCGATAAGGTTTCACATCT
```

```
           270               280                  290                300
T P E N K E F V E K Y K K Y G E D R V T D D P I E A A Y I G V Y L W A K A V E
TACACCGGAAAACAAGGAGTTCGTTGAGAAATATAAGAAAAGTATGGGGAGGAGACCGGGTGACAGATGACCAATCGAGGCGGCATACATCGGCGTATACTTATGGGCTAAAGCGGTTGA
ATGTGGCCTTTGTTCCTCAAGCAACTCTTTATATTCTTTTCATAACCCCTCCTGGCCACTGTCTACTGGGTTAGCTCCGCCTATGTAGCCGCATATGAATACCCGATTTCGCCAACT
          970       980       990      1000      1010      1020      1030      1040      1050      1060      1070      1080

310               320                  330                340
K A G S T D V D K V R E A A K G I E F N A P E G P V K I D G D N Q H L Y K T V R
GAAGGCGGGGTCGACAGACGTGGATAAGGTCCGGGAGGCCGCGAAGGGCATCGAATTTAACGCCCCAGAGGGCCCAGTAAAGATTGACGGCGACAACCAGCACCTCTACAAGACGGTGCG
CTTCCGCCCCAGCTGTCTGCACCTATTCCAGGCCCTCCGGGCGCTTCCCGTAGCTTAAATTGCGGGGTCTCCCGGGTCATTTCTAACTGCCGCTGTTGGTCGTGGAGATGTTCTGCCACGC
         1090      1100      1110      1120      1130      1140      1150      1160      1170      1180      1190      1200

350               360                  370                380
I G E I L E N G Q I R E L W K T N K P V K P D P Y L K G Y E W A Q G L S E Q G G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
ATAACCACTCTAGGACCTCTTGCCAGTTGTTAAGCACTCAACACCTTTTGTTATTTGGTCTCTAGGTATAAATTTTCCAATACTTACCCGTGTCCCAATTCGCTCGTTCCACC
         1210      1220      1230      1240      1250      1260      1270      1280      1290      1300      1310      1320

390
S H H H H H H * *
TTCACATCATCATCATCATCATTAATGAAAGGGCGATATCCAGCACACTGGCCGTCCGGCTGCTAACAAGCCCGAAAGGAAGCTGAGTTGGCTGCTGCCACCGCT
AAGTGTAGTAGTAGTAGTAGTAATTACTTTCCCGTACCTATAGGTCGTGTGACCGGCCAATGATCACCTAGCCAGACGATTGTTTCGGGCTTTCCTTGACTCAACCGACGACGGTGCCGA
         1330      1340      1350      1360      1370      1380      1390      1400      1410      1420      1430      1440

GAGCAATAACTAGCATAACCCCTTGGGCCTCTAAACGGGTTTTTTGCTGAAGGAGGAACTATATCCGGAGGCGACTCCCACGGCACGTTG
CTCGTTATTGATCGTATTGGGGAACCCCGGAGATTGCCCAGAAACTTGCCCCAAAAAACGACTTTCCTTGATATAGGCCTCGCTGAGGGTGCCGTGCAAC
         1450      1460      1470      1480      1490      1500      1510      1520      1530      1540

FIG. 95 (Continued)
```

FIG. 96 - Exemplary Expression Construct for csUBP7_186C.37

```
CGCTTGGGACTGCCATAGCTGGCCCGGTGATGCCGCCACGATGCTCGATCCCGCGGCGTAGAGGATCGAGATCTCGATCCCGCGAAATTAATACAGACTCACTATAGGGAGACCACAACGGTTTC
GCGAACCCTGATCCGACGGGCTACGGCGTGCTACCAGGCCGCATCCTAGCTCCTAGCTGGGCGCTTAATTATGCTGAGTGATATCCCTGGTGTTGCCAAAG
         10        20        30        40        50        60        70        80        90       100       110       120

CCTCTAGAAATAATTTTGTGTTTAAGTCCTCTATCAGTTCATCGAGTATACCATGAGTTCATCAGAATGCAGAAGAGACCATCAAAGTGAAGAGACCATCAAAGTAGGGATTCTCCACAGCTTGAGTGGTAC
GGAGATCTTATTAAACAAATGAAATTCTTCCTCATAGAGTACTCAAGTAGTCTTAGTCTTTTCTTTTTCTCTGGTAGTTTCATCCTAAGAGTGTCGAACTCACCATG
                              M   S   S   S   E   K   K   S   E   E   T   I   K   V   G   I   L   H   S   L   G   T
         130       140       150       160       170       180       190       200       210       220       230       240
                                                                          10                           20

GATGTCAATCTCAGAAGTTCCTTAAAGATGCCGAATTCATGGCGATCGAAGAGATCAACAATAATGGCGGTGTGTTAGGTAAAAAGTTAGAACCGATCGTGGAAGATGGCGCCTCAGA
CTACAGTTAGAGTCTTCAAGGAATTTCTACGGCTTAAGTACCGCTAGCTCTCGTAGTTGTTATTACCGCCACACAATCATTTTCAATCTTGGCTAGCACCTTCTACCGGAGTCT
 M   S   I   S   E   V   S   L   K   D   A   E   L   M   A   I   E   E   I   N   N   N   G   G   V   L   G   K   K   L   E   P   I   V   E   D   G   A   S   D
         250       260       270       280       290       300       310       320       330       340       350       360
          30                          40                          50                          60

CTGGCCGACCTTCGCTGAAAAGGCTAAGAAGCTTTACAGAAGGACAAGTTGGCAGTAATTTTCGGCCGTTGACCTGGCAAGCCGAACCTGAACCTGAGAGCCGTTCAGCGTTTCAGCGTTCAGCAGTCTTATT
GACCGGCTGAAGCGACTTTTCCGATTCTTTGAAAATGTCTTCCTGTTCCACCGTCATTAAAAGCCGGCAATGAGCCGGCAACTTGGACGCTTCGGCATGAGGGTCAGCAGCTTCTTTTATT
 W   P   T   F   A   E   K   A   K   K   L   L   Q   K   D   K   V   A   V   I   F   G   A   W   T   S   A   S   R   K   A   V   L   P   V   V   E   E   N   N
         370       380       390       400       410       420       430       440       450       460       470       480
                          70                          80                          90                         100

TGGGCTTCTCTCTATCCGGTTCAGTATGGAAGGTCTCGAAAGTTCCCAAATATCTTTTACATGGGCGCCGCCCCAAACCAGCAGATCGTGCCAGCAGTTAAATGGCTCTTCGACAACGG
ACCCGAAGAGAAGATAGGCCAAGTCATACTTCCAGAGCTTTCAAGGGGTTTATAGAAAATGTACCCGCGGCGGGGTTTGGTCGTCTAGACGGTCGTCAATTTACCGAGAAGCTGTTGCC
 G   L   L   F   Y   P   V   Q   Y   E   G   L   E   S   S   P   N   I   F   Y   M   G   A   A   P   N   Q   Q   I   V   P   A   V   K   W   L   F   D   N   G
         490       500       510       520       530       540       550       560       570       580       590       600
                         110                         120                         130                         140

TAAGAAGCGGTTCTACCTCTGGGCTCGGATTATGATTATTCCCACGCACAGCAGCATACCTCAAATACCTCGGCGGTGTTGTAGTAGTGAAGAATACACCCATG
ATTCTTCGCAAAGATGGAGACCCGAGCGTAATACAATAAGGGTGCGTCGTTGTCTCAATAATTCCGATGAGTTTTATGGAGCCGCCACAACATCATCCACTTCTATGTGGGGTAC
 K   K   R   F   Y   L   L   G   S   D   Y   V   F   P   P   R   T   A   N   K   I   I   K   A   Y   L   K   Y   L   G   G   V   V   V   G   E   E   Y   T   P   C
         610       620       630       640       650       660       670       680       690       700       710       720
                         150                         160                         170                         180

TGGTCACACTGACTATAGTTCTGTCATTAATAAATCAAAGCCGCAGAGCGTCGTATTTAACACTCGTATTTAACACTCGAACTGTGAGACTTGCAGCATAATCATTACATCGGAAAAATTCGTTAATTCCTACGGCC
ACCAGTGTGACTGATATCAAGACAGTACATCAAGACAGTAATAATATTTATTTAGTTTAGTAGTCTTCGGCGTTGTCGGCATTACAATCATCAGCATAATCATTACATCGGAAAAATTCGTTAATTCCTACGGCC
 G   H   T   D   Y   S   S   V   I   N   K   I   H   K   A   A   K   P   D   V   V   F   N   T   L   N   G   D   S   N   V   A   F   F   K   Q   L   K   D   A   G
         730       740       750       760       770       780       790       800       810       820       830       840
                         190                         200                         210                         220

TGGTCACACTGACTATAGTTCTGTCATTAATAAATCAAAGCCGCAGAGCGTCGTATTTAACACTCGTATTTAACACTCGAACTGTGAGACTTGCAGCATAATCATTACATCGGAAAAATTCGTTAATTCCTACGGCC
GATTGACGCAAATACACTCCCTGTCATGAGCCGTGAACATCGCCGAGGAGATCAAAGGCATTGGTGTCCAGATGTATTTAAAGTCATCTGCTCACATGAACTATTCCAAGTGTAGA
 I   D   A   N   T   L   P   V   M   S   V   N   I   A   E   E   I   K   G   I   G   P   E   Y   L   K   G   H   L   V   T   W   N   Y   F   Q   S   V   D
         850       860       870       880       890       900       910       920       930       940       950       960
                         230                         240                         250                         260
```

```
         270                  280                  290                  300
T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAAACAAGGAGTTCGTTGAGAAGTACAAAAAGTATGGGGAGGACCGGGTGACAGATGACCAATCGAGGCGGCATAATCGGCGTATACTTATGGCTAAAGCGGTTGA
ATGTGGCCTTTGTTCCTCAAGCAACTCTTTATATTCTTTTTCATATCCCTCTGGCCCACTGTCTACTGGGTTAGCTCCGCCGTATGTAGCCGCATATGAATACCCGATTTCGCCAACT
   970       980       990      1000      1010      1020      1030      1040      1050      1060      1070      1080

310                  320                  330                  340
K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAAGGGCATCGAATTTAACGCCCCAGAGGGCCCAGTAAAGATTGACGGCGACAACCAGCACCTCTACAAGACGGTGCG
CTTCCGCCCAGCTGTCTGCACCTATTCCAGGCGCGCTTCCCGGGTCTCATTTGCGGGTTCTAAATTGCGGGGCTTAAACTGCCGCTGTTGGTCGTGGAGATGTTCTGCCACGC
  1090      1100      1110      1120      1130      1140      1150      1160      1170      1180      1190      1200

350                  360                  370                  380
I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
ATAACCACTCTAGGACCTCTTGCCAGTTTAAGCACTCAACACCTTTGTTATTTGGTCTAGGTATAAATTTTCCAATACTTACCCGTGTCCCCAATTCGCTCGTTCCACC
  1210      1220      1230      1240      1250      1260      1270      1280      1290      1300      1310      1320

390
S  H  H  H  H  H  *  *
TTCACATCATCATCATCATCATTAATGAAAGGGCGATATCCAGCACACTGGCGCCGTTACTAGTGGATCCGGCTCGTAACAAGCCCGAAAGGAAGCTGAGTTGGCTGCTGCCACCGCT
AAGTGTAGTAGTAGTAGTAGTAATTACTTTCCCGCTATAGGTCGTGTGACCGCCAATGATCACCTAGCGCCGACGATTGTTTCGGGCTTTCCTTCGACTCAACCGACGACGGTGGCGA
  1330      1340      1350      1360      1370      1380      1390      1400      1410      1420      1430      1440

GAGCAATAACTAGCATAACCCCTTGGGCCTCTAAACGGGTCTTTTTGCTGAAAGAGGAACTATATCCGGAGCGACTCCCACGGCACGTTG
CTCGTTATTGATCGTATTGGGAGAACCCCGAGAATTGCCCAGAAACGACTTTCCTCCTTGATATAGGCCTCGCTGAGGGTGCCGCGTGCAAC
  1450      1460      1470      1480      1490      1500      1510      1520      1530      1540

FIG. 96 (Continued)
```

FIG. 97 - Exemplary Expression Construct for csUBP7_18GC.38

```
      270                      280                       290                       300
 T  P  E  N  K  E  F  V  E  K  Y  K  K  Y  G  E  D  R  V  T  D  D  P  I  E  A  A  Y  I  G  V  Y  L  W  A  K  A  V  E
TACACCGGAAACAAGGAGTTCGTTGAGAAGTATAAGAAATATGGGGAGGACCGGGTGACAGATGACCCAATCGAGGCGGCATACATCGGCGTATACTTATGGGCTAAAGCGGTTGA
ATGTGGCCTTTGTTCCTCAAGCAACTCTTTATATTCTTTTCATATCGGGTTAGCTCCGCCGTATGTAGCCGCATATGAATACCCGATTTCGCCAACT
   970       980       990      1000      1010      1020      1030      1040      1050      1060      1070      1080
      310                      320                       330                       340
 K  A  G  S  T  D  V  D  K  V  R  E  A  A  K  G  I  E  F  N  A  P  E  G  P  V  K  I  D  G  D  N  Q  H  L  Y  K  T  V  R
GAAGGCGGGGTCGACAGACGTGGATAAGGTCCGGGAGGCCGCGAAAGGGCATCGAATTTAACGCCCCAGAGGGCCCAGTAAAGATTGACGGCGACAACCAGCACCTCTACAAGACGGTGCG
CTTCCGCCCCAGCTGTCTGCACCTATTCCAGGCCCTCCCGGCGCTTCCCGGTCTAAATTGCGGGGTCATTTCTAACTGCCGCTGTTGGTCGTGGAGATGTTCTGCCACGC
  1090      1100      1110      1120      1130      1140      1150      1160      1170      1180      1190      1200
      350                      360                       370                       380
 I  G  E  I  L  E  N  G  Q  I  R  E  L  W  K  T  N  K  P  V  K  P  D  P  Y  L  K  G  Y  E  W  A  Q  G  L  S  E  Q  G  G
TATTGGTGAGATCCTGGAGAACGGTCAAATTCGTGAGTTGTGGAAAACAAATAAACCAGTTAAACCAGATCCATATTTAAAAGGTTATGAATGGGCACAGGGGTTAAGCGAGCAAGGTGG
ATAACCACTCTAGGACCTCTTGCCAGTTAAGCACTCAACACCTTTTGTTTATTTGGTCTAGGTATATTCCAATACTTACCCGTGTCCCAATTCGCTCGTTCCACC
  1210      1220      1230      1240      1250      1260      1270      1280      1290      1300      1310      1320
      390
 S  H  H  H  H  H  *  *
TTCACATCATCATCATCATCATTAATGAAAGGGCGATATCCAGCACACACTGGCCGTTACTAGTGGATCCGGCTGCTAACAAAGCCCGAAAGGAAGCTAGTTGGCTGCTGCCACCGCT
AAGTGTAGTAGTAGTAGTAGTAATTACTTCCCGCTATAGGTCGTGTGACCTAGCCGACGATTGTTCGGGCTTTCCTTCGACTCAACCGACGACGGTGCCGA
  1330      1340      1350      1360      1370      1380      1390      1400      1410      1420      1430      1440

GAGCAATAACTAGCATAACCCCTTGGGCCTCTAAACGGGTCTTTTTTGCTGAAAGAGGAACTATATCCGGAGGCGACTCCCACGGCACGTTG
CTCGTTATTGATCGTATTGGGGAACCCCGAGAATTGCCCAGAAACTTCCTCCTTGATATAGGCCTCGCTGAGGGTGCCGTGCAAC
  1450      1460      1470      1480      1490      1500      1510      1520      1530      1540
```

FIG. 97 (Continued)

FIG. 98 - Exemplary Expression Construct for csUBP7_186C.39

```
CGCTTGGGACTGCCATAGCTGGCCCGGTGATGCCGGCCACGATGCGTCGATCGAGATCTCGATCCCGCGTAGAGATCATCACTACTATAGGGAGACCACAACGGTTTC
GCGAACCCTGATCCGACCGGGACCTACGGCCGTGCTACGCAGGCCCATCCTCTAGCTCCTAGCTCCTAGCTAGGGCGCTTAATTATGCTGAGTGATATCCCTCGTGTTGCCAAAG
         10        20        30        40        50        60        70        80        90       100       110       120

CCTCTAGAAATAATTTGTTAACTTTAAGAAGGAGATATACCATGAGTTCATCAGAGAATCAGAAAAAAGAAGAGACCATCAAAGTAGGGATTCTCCACAGCTTGAGTGGTAC
GGAGATCTTTATTAAAACAAATTGAAATTCTTCCTCTATATGGTACTCAAGTAGTCTTAGTCTTTTCTTTTCACTTCTCTGGTAGTTTCATCCCTAAGACGTGTCGAACTCACCATG
                                                M  S  S  S  E  K  S  E  E  T  I  K  V  G  I  L  H  S  L  G  T
        130       140       150       160       170       180       190       200       210       220       230       240
                                                                                    10                    20

40
GATGTCAATCTCAGAGAGTTCCTTAAAGATGCCGAATTAATGGCCATCGAAGAGATCAACAATAATGGCGGTGTGTTAGGTAAAAAGTTAGAACCGATCGTGGAAGATGGCGCCTCAGA
CTACAGTTAGAGTCTCTCAAGGAATTTCTACGGCTTAATTACCGGTAGCTTACACAATCATTTTCAATCTTGGCTAGCACCTTCTACCGCGGAGTCT
 M  S  I  S  E  V  S  L  K  D  A  E  L  M  A  I  E  E  I  N  N  N  G  G  V  L  G  K  K  L  E  P  I  V  E  D  G  A  S  D
        250       260       270       280       290       300       310       320       330       340       350       360
 30                                                                     50                                       60

80
CTGGCCCGACCTTCGCTGAAAAGGCTAAGAAACTTTTACAGAAGGACAAGGTTGCAGTAATTTTCGGCGCTTGACCTGGCCAAAGCCCGTACTCGCAAGTCGTCGAAGAAATAA
GACCGGGCTGGAAGCGACTTTCCGATTCTTTGAAAATGTCTTCCTGTTCCACCGTCATTAAAAGCCCGCGAACCTGGAGCCGTTCAGCGTTTCGGCATGAGAGGTCAGCAGCTTCTTTATT
 W  P  T  F  A  E  K  K  A  K  K  L  L  Q  K  D  K  V  A  V  I  F  G  A  W  T  S  A  S  R  K  A  V  L  P  V  V  E  E  N  N
        370       380       390       400       410       420       430       440       450       460       470       480
 70                                                     80                                       90                              100

140
TGGGCTTCTCTCTATCCGGTTCAGTAGTGAAGGTCTCGAAAGTTCCCAAATATCTTTACATGGGCGCCGCCCCAAACCAGCAGATCGTGCCAGCAGTTAAATGGCTTCGACAACGG
ACCCGAAGAAGATAGGCCAAGTCATACTTCCAGAGCTTTCAAGGGGTTATTCAAGGGTTATTTATAGAAAATGTACCCGCGGGTTTGGTCGTCTAGCACGGTCGTCAATTTACCGAAGCTGTTGCC
 G  L  L  F  Y  P  V  Q  Y  E  G  L  E  S  S  P  N  I  F  Y  M  G  A  A  P  N  Q  Q  I  V  P  A  V  K  W  L  F  D  N  G
        490       500       510       520       530       540       550       560       570       580       590       600
110                                                    120                                      130

180
TAAGAAGCGTTTCTACCTCTTGGGCTCCGATTATGTATTCCCACGCAGCACAGCACAAACAAGATTATTAAGGCATACCTCAAATACCTCGGCGGTGTTGTAGTAGTGAAGAATACACCCATG
ATTCTTCGCAAAGATGGAGACCCGAGCCTAATACATAAGGGTGCGTGCGTTGTCGTTTGTCTCTCAATAATTCCGTATGGAGTTTATGAGCCGCCACAACATCATCCACTTCTTATGTGGGGTAC
 K  K  R  F  Y  L  L  G  S  D  Y  V  F  P  R  T  A  N  K  I  I  K  A  Y  L  K  Y  L  G  G  V  V  V  G  E  E  Y  T  P  C
        610       620       630       640       650       660       670       680       690       700       710       720
150                                                    160                                      170

220
TGGTCACACTGACTATAGTTCTGTCATTAATAAATCAAAGCCGCAAAGCCAGACGTTCGGTCTGCAGCATAAATTGTGAGACTTGCGGCGAAAAAGTTCGTTAATTTCCTACGGCC
ACCAGTGTGACTGACTATCAAGACAGTATCAAGACAGTATCGCACGTATAGCGGCTCCTCCTCTAGTTTCCGTAGACCAGTCTCATAAATTCCAGTAGACCAGTGTACCTTGATAAAGGTTCAAATCT
 G  H  T  D  Y  S  S  V  I  N  K  I  K  A  A  K  P  D  V  V  F  N  T  L  N  G  D  S  N  V  A  F  F  K  Q  L  K  D  A  G
        730       740       750       760       770       780       790       800       810       820       830       840
190                                                    200                                      210

260
GATTGACGCAAATACACTCCCTGTCATGACGTGCATATCGCCGAGGAGATCAAAGGCATTGGTCCAGAGTATTTAAAAGTCATCTGTCACATGAGTACCTTGATAAGGTTTCACATCT
CTAACTGCGTTATGCTGAGGGACAGTACTCGCACGTATAGCGGCTCCTCCTCTAGTTTCCGTAGACCAGTCTCATAAATTCCAGTAGACCAGTGTACCTTGATAAAGGTTCAAATCT
 I  D  A  N  T  L  P  V  M  S  V  H  I  A  E  E  I  K  G  I  G  P  E  Y  L  K  G  H  L  V  T  W  N  Y  F  Q  S  V  D
        850       860       870       880       890       900       910       920       930       940       950       960
230                                                    240                                      250
```

```
                           270                                     280                                     290                                     300
               T  P  E  N  K  E  F  V  E  K  Y  K  K  K  Y  G  E  D  R  V  T  D  D  P  I  E  A  A  Y  I  G  V  Y  L  W  A  K  A  V  E
               TACACCGGAAAACAAGGAGTTCGTTGAGAAGAGTTCGTTGAGAAATATAAGAAAAAGTATGGGGAGGACCGGGTGACAGATGACCAATCGAGGCGGCATACATCGGCGTATACTTATGGGCTAAAGCGGTTGA
               ATGTGGCCGTTTGTTCCTCAAGCAACTCTTTATATTCTTTTTCATAACCCCTCCTGGCCCACTGTCTACTGGGTTAGCTCCGCCGTATGTAGCCGCATATGAATACCCGATTTCGCCAACT
                970        980        990       1000       1010       1020       1030       1040       1050       1060       1070       1080

310                                     320                                     330                                     340
               K  A  G  S  T  D  V  D  K  V  R  E  A  A  K  G  I  E  F  N  A  P  E  G  P  V  K  I  D  G  D  N  Q  H  L  Y  K  T  V  R
               GAAGGCGGGGTCGACAGACGTGGATAAGGTCCGGGAGGCCGCGAAGGGCATCGAATTTAACGCCCAGTAAAGATTGACGGCGACAACCAGCACCTCTACAAGACGGTGCG
               CTTCCGCCCCAGCTGTCTGCACCTATTCGAGGCCCTCGCGGCTTCCAGGCGCTTCCCGGGTCTCATTTCTAAATTGCGGGGTCATTTCTAACTGCCGCTGTTGGTCGTGGAGATGTTCTGCCACGC
               1090       1100       1110       1120       1130       1140       1150       1160       1170       1180       1190       1200

350                                     360                                     370                                     380
               I  G  E  I  L  E  N  G  Q  I  R  E  L  W  K  T  N  K  P  V  K  P  D  P  Y  L  K  G  Y  E  W  A  Q  G  L  S  E  Q  G  G
               TATTGGTGAGATCCTGGAGAACGGTCAAATTCGTGAGTTGTGGAAAACAAATAAACCAGTTAAGCCTTATGAATGGGCACAGGGGTTAAGCGAGCAAGGTGG
               ATAACCACTCTAGGACCTCTCGCCAGTTTAAGCACTCAACACCTTTGTTATTTGGTCTCTAGTGACTTGTCAATTTGCAATACTACCCGTGTCCCAATTCGCTCGTTCCACC
               1210       1220       1230       1240       1250       1260       1270       1280       1290       1300       1310       1320

390
               S  H  H  H  H  H  *  *
               TTCACATCATCATCATCATTAATGAAAGGGCGATATCCAGCACACTGGCCGTCCGGCCTGCTACTAGTGGATCGGATCCGCTCGATCCGAACGAAGCCGAAAGGAAGCTGAGTTGGCTGCTGCCACCGCT
               AAGTGTAGTAGTAGTAGTAGTAATTACTTTCCCGCTATAGGTCGTGTGACCGGCCAATGATCAACCTAGGCCGACGATTGTTTCGGGCTTTCCTTGCACTCAACCGACGACGGTGCCGA
               1330       1340       1350       1360       1370       1380       1390       1400       1410       1420       1430       1440

GAGCAATAACTAGCATAACCCCTTGGGCCTCTAAACGGGTCTTTGAGGGGTTTTTTGCTGAAAGAGGAACTATATCCGGAGCGACTCCCACGGCACGTTG
               CTCGTTATTGATCGTATTGGGAACCCCGGAGATTTGCCCAGAAACGACTTTCCTCCTTGATATAGGCCTCGCTGAGGGTGCCGCGTGCAAC
               1450       1460       1470       1480       1490       1500       1510       1520       1530       1540

FIG. 98 (Continued)
```

FIG. 99 - Exemplary Expression Construct for csUBP7_26C_bzif

```
      270                     280                         290                        300
 V  D  T  P  E  N  K  E  F  V  E  K  Y  K  K  K  Y  G  E  D  R  V  T  D  D  P  I  E  A  A  Y  I  G  V  Y  L  W  A  K  A
TGTAGATACACCCGGAAAACAAGGAGTTCGTTGAGAAGTATAAGAAAAAGTATGGGAGGACCGGGTGACAGATGACCCAATCGAGGCGGGCATACATCGGCGGCTATACTTATGGGCTAAAGC
ACATCTATGTGGCCTTTTGTTCCTCAAGCAACTCTTTGTTTTCATACACCCTCCTGGCCCACTGTCTACTGGGTTAGCTCCGCCGTATGTAGCCGCATATGAATACCCGATTTCG
     970        980        990       1000       1010       1020       1030       1040       1050       1060       1070       1080

310                        320                    330                    340
 V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCAGCAGACGTGGATAAGGTCCGGGAGGCCGCGAAGGGCATCGAATTTAACGCCCCAGAGGGCCCAGTAAAGATTGACGGCGACAACCAGCACCTCTACAAGAC
CCAACTCTTCCGCCCACCAGCTGTCTGCACCTATTCCAGGCCCTCCGGCGCTTCCCGTAAACTTAAATTGCGGGGTCATTTCTAACTGCCGCTGTTGGTCGTGGAGATGTTCTG
     1090       1100       1110       1120       1130       1140       1150       1160       1170       1180       1190       1200

350                    360                        370                        380
 V  R  I  G  E  I  L  E  N  G  Q  I  R  E  L  W  K  T  N  K  P  V  K  P  D  P  Y  L  K  G  Y  E  W  A  Q  G  L  S  E  Q
GGTGCGTATTCGTGAGATCCTGGAGAACGGTCAAATTCGTGAGTTGTGGAAAACAAATAACCAGTTAAACCAGATCCATATTTAAAAGTTATGAATGGCACAGGGTTAAGCGAGCA
CCACGCATAACCACTCTAGGACCTCTTGCCAGTTTTAAGCACTCAACACCCTTTGTTTATTGGTCAATTTGCTCTAGGTATAAATTTTCAATACTTACCCGTGTCCCCAATTCGCTCGT
     1210       1220       1230       1240       1250       1260       1270       1280       1290       1300       1310       1320

400                        410
 G  G  S  G  G  S  T  G  E  K  P  Y  K  C  P  E  C  G  K  S  F  S  R  S  G  G  S  H  H  H  H  H  H  *
AGGCGGCAGCGGCCAGCACCGGCGAAATACCGTATAAATGTCCGGAATGTGGCAAAAGCTTTAGCCGCAGCCGTGGTTCACATCATCATCATCATTAATGAAAGGGCGATATCCA
TCCGCCGTCGCCGGTCGTGGCCGCTTTATGGCATATTTACAGGCCTTACACCGTTTCGAAATCGGACGTCGCCACCAAGTGTAGTAGTAGTAATTACTTTCCCGCTATAGGT
     1330       1340       1350       1360       1370       1380       1390       1400       1410       1420       1430       1440

GCACACTGGCGGCCGCCGGCCGTTACTAGTAGGATCCGGGCTGCTCTAACAAAGCCCGAAAGGAAGCTGAGTGGTGGCTGCGCCACCGCGCTGAGCAATAACTAGCAATAACCCTTGGGGCCTCTAAACGGGTC
CGTGTGACCGCCGGCGGCCGGCAATGATCATCCTAGGCCCGACGAGATTGTTTCGGGCTTTCGGCTTTCGGCTTCCTCGACTCAACCGACGTGGCGACTCGTTATTGATCGTATTGGGAACCCCGGAGATTTGCCCAG
     1450       1460       1470       1480       1490       1500       1510       1520       1530       1540       1550       1560

TTGAGGGGTTTTTGCTGAAAGGAGGAACTATATCCGGAGCGACTCCACGGCAGCTTGGCAAGCTCG
AACTCCCAAAAAACGACTTTCCTCCTTGATATAGGCCTTGCGGTGCCGTGCAACCGTTCGAGC
     1570       1580       1590       1600       1610       1620
```

FIG. 99 (Continued)

FIG. 100 - Exemplary Expression Construct for csUBP7_27C_bzif

```
       270              280              290              300
V  D  T  P  E  N  K  E  F  V  E  K  Y  K  K  K  Y  G  E  D  R  V  T  D  D  P  I  E  A  A  Y  I  G  V  Y  L  W  A  K  A
TGTAGATACACCCGGAAAACAAGGAGTTCGTTGAGAAGTATAAGAAAAAGTATGGGGAGGACCGGGTGACAGATGACCCAATCGAGGCGGGCATACATCGGCGGCTATACTTATGGGCTAAAGC
ACATCTATGTGGCCTTTTGTTCCTCAAGCAACTCTTTTATATTCTTTTTCATACACCCCTCCTGGCCCACTGTCTACTGGGTTAGCTCCGCCGTATGGCCGCATATGAATACCCGATTTCG
    970       980       990      1000      1010      1020      1030      1040      1050      1060      1070      1080

310              320              330              340
V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACAGACGTGGATAAGGTCCGGGGAGGCGCCGCCAAGGGCATCGAATTTAACGCCCCAGAGGGCCCAGTGAAAGATTGACGGCGACAACCAGCACCTCTACAAGAC
CCAACTCTTCCGCCCCAGCTGTCTGCACCTATTCCAGGCCCCTCCGGGGCGGTTCCCGGGTCATTTCTAACTGCCGCTGTTGGTCGTGGAGATGTTCTG
   1090      1100      1110      1120      1130      1140      1150      1160      1170      1180      1190      1200

350              360              370              380
V  R  I  G  E  I  L  E  N  G  Q  I  R  E  L  W  K  T  N  K  P  V  K  P  D  P  Y  L  K  G  Y  E  W  A  Q  G  L  S  E  Q
GGTGCGTATTCGTGAGATCTGGAGAACGGTCAAATTCGTGAGTGTGGAAAACAAATAAACCAGTAAACCAGATCCATATTTAAAAGGTTATGAATGGGCACAGGGGTTAAGCGAGCA
CCACGCATAACCACTCTAGGACCTCTTGCCAGTTAAGCACTCAACACCCTTTTGTTTATTTGTTTGTCTAGTATAAATTTTCAATACTTACCCGTGTCCCCAATTCGCTCGT
   1210      1220      1230      1240      1250      1260      1270      1280      1290      1300      1310      1320

390              400              410
G  G  S  G  G  S  T  G  E  K  P  Y  K  C  P  E  C  G  K  S  F  S  R  S  G  G  S  H  H  H  H  H  H  *
AGGCGCCAGCGGGCCAGCACCGGCGGCTAATAAACCGTATAAATGTCCGAATGTGGCAAAAGCTTTAGCCGCAGCCGTGGTTCACATCATCATCATCATTAATGAAAGGCGATATCCA
TCCGCCGTCGCCGGCCGTTCGGCCGCGTTATTATGCAGGCCGTCGAAATCGGCGCGTCGCCACCAAGTGTAGTAGTAGTAGTAGTAATTACTTTCCCGCTATAGGT
   1330      1340      1350      1360      1370      1380      1390      1400      1410      1420      1430      1440

GCACACTGGCGGCCGCCGTTACTAGTAGTCCGGCTGGATCCGGCTGCTAACAAAGCCCGAACAAGGAAGAAGCTGAGTGGCTGCTGCCACCGCTGAGCAATAACCCTTGGGGCCTCTAAACGGGTC
CGTGTGACCGCCGGCCGGCAATGATCACCAGGCCGACGATTGTTTCGGCTTTCGTCAACGACGCGGTGGCGACTCGCTATTGATCGTATTGGGAACCCCCGGAGATTTGCCCAG
   1450      1460      1470      1480      1490      1500      1510      1520      1530      1540      1550      1560

TTGAGGGGTTTTTTGCTGAAGAGGAGGAACTATATCCGGAGCGACTCCACGGCACGTTGGCAAGCTCG
AACTCCCAAAAAAACGACTTTTCCTCCTTGATATAGGCCTCGCTGAGGGTGCCGTGCAACCGTTCGAGC
   1570      1580      1590      1600      1610      1620

FIG. 100 (Continued)
```

FIG. 101 - Exemplary Expression Construct for csUBP7_30C_bzif

```
CGGTCACGCTTGGGACTGCCATAGGCTGCGCCGGTCTGGCCCGGTGATGCCGGTCGATGATCTCGATCCCGCGAAATTAATACGACTCACTATAGGAGACCACAAC
GCCAGTGCGAACCCTGACGGTATCCGACGGGCCACTACGGCCCGGTGCTACGCGCCGGGTGCTAGAGCTAGGGCGCTTTAATTATGCTGAGTGATATCCTCTGGTGTTG
          10        20        30        40        50        60        70        80        90       100       110       120

M  S  S  S  E  K  E  K  S  E  E  T  I  K  V  G  I  L  H  S  L  S
GGTTTCCCTCTAGAAATAATTTTGTTGTTAACTTTTAAGAGGAGATATACCATGAGTTCATCAGAATCAGAAAAAGTGAAGAGACCATCAAAGTAGGGATTCTCCACAGCTTGAG
CCAAAGGGAGATCTTTATTAAAACAATTGAAATTCTCCTCTATATGGTACTCAAGTAGTCTTAGTCTTTTTCACTTCTCTGGTAGTTCATCCCTAAGAGGTGTCGAACTC
         130       140       150       160       170       180       190       200       210       220       230       240

20                         30                               40                              60
 G  T  M  S  I  C  E  V  S  L  K  D  A  E  L  M  A  I  E  E  I  N  N  G  G  V  L  G  K  K  L  E  P  I  V  E  D  G  A
TGGTACGATGTCAATCTGTGAAGTTCCTTAAAGATGCCGAATTAATGGCAATCGAAGAGATCAACAATAATGGCGGTGTGTTAGTAAAAAGTAGACCGATCGTGGAAGATGGCGC
ACCATGCTACAGTTAGACACTTCAAGGAATTTCTACGGCTTAATTACCGTTAATTACCGTCAGTTGTTATTACCGCCACACAATCCATTTTCAATCTGGCTAGCACTTGGCTAGCACTTCTACCGCG
         250       260       270       280       290       300       310       320       330       340       350       360

80                                                        100
 S  D  W  P  T  F  A  E  K  A  K  K  L  L  Q  K  D  K  V  A  V  I  F  G  A  W  T  S  A  S  R  K  A  V  L  P  V  V  E  E
CTCAGACTGGCCCGACCTTCGCTGAAGAGCATAAAGGCTAAGAAACTTTTACAGAAGGACAAGGTGGCAGTAATTTTCGGCGCCTTGGACCTCGGCAAGCCGCAAAGCCGTACTCCCAGTCGTCGAAGA
GAGTCTGACCGGGCTGGAAGCGACTTCTTCCGATCTTCGATTCTTTGAAAAATGTCTTCCTGTTCCACCGTCATTAAAAGCCGCGAACCTGGAGCCGTTCGGCATGGCGTTCAGCAGCTTCT
         370       380       390       400       410       420       430       440       450       460       470       480

110                                     120                               130                               140
 N  N  G  L  L  F  Y  P  V  Q  Y  E  G  L  E  S  S  P  N  I  F  Y  M  G  A  A  P  N  Q  Q  I  V  P  A  V  K  W  L  F  D
AAATAATGGGCTTCTCTTCATCCGGTTCAGTATGAAGGTCTCGAATTACTTTCCCAAATATCTTTTACATGGGCGCCGCCCAAACCAGCAGATCGTGCCAGCAGTAAATGGCTCTTCGA
TTATTACCCGAAGAGAAGATGAGGCCAAGTCATACTTCCAGAGCTTATGAAAGGGTTTCAAGAGCTTTATAGAAAATGTACCCGCGGCGGGGTTTGGTCGTCTAGCACGGTCGTCAATTTACCGAGAAGCT
         490       500       510       520       530       540       550       560       570       580       590       600

160                                      170                               180
 N  G  K  K  R  F  Y  L  L  G  S  D  Y  V  F  P  R  T  A  N  K  I  I  K  A  Y  L  K  Y  L  G  G  V  V  G  E  E  Y  T
CAACGGTAAGAAGCGTTTCTACCTCTTGGGCTCGGATTATGTATTCCCACGCACAGCAAACAAGATTATTAAGGCATACCTCAAATACCTCGGCGGTGTGTGTAGTAGTGAAGAATACAC
GTTGCCATTCTTCGCAAAGATGAGAACGCCGAGCTAATACATAAGGGTGCGTGTCGTTTGTTCTAATAATTCCGTATGAGTTTATGGAGCCGCCACACATCATCACTCTTATGTG
         610       620       630       640       650       660       670       680       690       700       710       720

190                           200                               210                               220
 P  L  G  H  T  D  Y  S  S  V  I  N  K  I  K  A  A  K  P  D  V  V  F  N  T  L  N  G  D  S  N  V  A  F  F  K  Q  L  K  D
CCCACTGGGTCACACTGACTATAGTTCTGTCATTAATAAATCAAAATAAAATCAAAGCCCGACAAGCCAGAGTCTGATTAACACTCTGAACGGGGATAGTAGCCTTTTCAAGCAATTAAAGGA
GGGTGACCCAGTGACTGATGATCAAGAGCAGTAATTATTTTAGTTGTCAGTTAAATATTTAGTTTCGGCCGTTTCGGAAGACTTGCAGCATAAATGTGAGACTTGCCACATGAAAAAGTTCGTTAATTCCT
         730       740       750       760       770       780       790       800       810       820       830       840

240                                             250                               260
 A  G  I  D  A  N  T  L  P  V  M  S  V  S  I  A  E  E  I  K  G  I  G  P  E  Y  L  K  G  H  L  V  T  W  N  Y  F  Q  S
TGCCCGGGATTGACGCAAATACACTCCCTGTCATGAGCGTGAGCATCCGCGAGGAGATCAAAGGCATTGGTCCAGAGTATTTAAAGGTCATCTGGTCACAGTGAACTATTTCCAAAG
ACGGGCCCTAACTGCGTTATGTGAGGGACCAGTACTGCCACTCGTAGCGCCTCCGTAGTTCCGTAACCAGCATCCATAAATTTTCCAGTAGACCAGTGTACCTTGATAAAGGTTC
         850       860       870       880       890       900       910       920       930       940       950       960
```

```
        V  D  T  P  E  N  K  E  F  V  E  K  Y  K  K  K  Y  G  E  D  R  V  T  D  D  P  I  E  A  A  Y  I  G  V  Y  L  W  A  K  A
      TGTAGATACACCCGGAAAACAAGGAGTTCGTTGAGAAGTATAAGAAAAAGTATGGGGAGGACCGGTTGACAGATGACCCAATCGAGGCGGGCATACATCGGCGGCTATACTTATGGGCTAAAGC
      ACATCTATGTGGCCTTTTGTTCCTCAAGCAACTCTTTTATATTCTTTTTGAGAATATATAAGAAAAAGTATGGGGAGGACCGGTTGACAGATGACCCAATCGAGGCGGGCATACATCGGCGGCTATACTTATGGGCTAAAGC
             970       980       990      1000      1010      1020      1030      1040      1050      1060      1070      1080
        V  E  K  A  G  S  T  D  V  D  K  V  R  E  A  A  K  G  I  E  F  N  A  P  E  G  P  V  K  I  D  G  D  N  Q  H  L  Y  K  T
      GGTTGAGAAGGCGGGTCGACAGACGTGGATAAGGTCCGGGAGGAGGCCGCCAAGGGCATCGAATTTAACGCCCCAGAGGGCCCAGTAAAGATTGACGGCGACAACCAGCACCTCTACAAGAC
      CCAACTCTTCCGCCCACCAGCTGTCTGCACCTATTCCAGGCGGTTCCCGTAGCTTAAATTGCGGGGTCATTTCTAACTGCCGCTGTTGGTCGTGGAGATGTTCTG
             1090      1100      1110      1120      1130      1140      1150      1160      1170      1180      1190      1200
        V  R  I  G  E  I  L  E  N  G  Q  I  R  E  L  W  K  T  N  K  P  V  K  P  D  P  Y  L  K  G  Y  E  W  A  Q  G  L  S  E  Q
      GGTGCGTATTGGTGAGATCCTGGAGAACGGTCAAATTCGTGAGTTGTGGAAAACAATAAACCAGTTAAACCAGATCCATATTTAAAAGGTTATGAATGGGCACAGGGGTTAAGCGAGCA
      CCACGCATAACCACTCTAGGACCTCTTGCCAGTTGCCAAGTTTAAGCACTCAACACCCTTTGTTTATTGGTCTAGTATAAATTTTCCAATAGTACCCGTGTCCCCAATTCGCTCGT
             1210      1220      1230      1240      1250      1260      1270      1280      1290      1300      1310      1320
        G  G  S  G  G  S  T  G  E  K  P  Y  K  C  P  E  C  G  K  S  F  S  R  S  G  G  S  H  H  H  H  H  H  *
      AGGCGCAGGCAGCGGCAGCACCGGCGAATGTCCGGAATGTGGCAAAACCTATAAATGTCCGGAATGTGGCAAAAGCTTTAGCCGCAGTCGGTGGTTCACATCATCATCATCATCATTAATGAAAGGGCGATATCCA
      TCCGCGTCCGTCGCCGTCGCCGTCGTGGCCGCGTTACAGGCCTTACAGGCCTTTACGCCGCGTCGCCACCAAGTGTAGTAGTAGTAGTAGTAATTACTTTCCCGCTATAGGT
             1330      1340      1350      1360      1370      1380      1390      1400      1410      1420      1430      1440
      GCACACTGGCGGCCGCCGGCCCGTTACTAGTAGGATCCGGCTGCTAACAAAGCCCGAAAGGAAGCTGAGTTGGCTGCTGCTGAGCAATAACATAGCATAACCCCTTGGGCCTCTAAACGGGTC
      CGTGTGACCGCCGGCGGCCGGGCAATGATCATCCTAGGCCGACGATTGTTTCGGGCTTTCGTTCGACTGACTGACTCGTTATTGATGTATTGGGAACCCCCGGAGATTTGCCCAG
             1450      1460      1470      1480      1490      1500      1510      1520      1530      1540      1550      1560
      TTGAGGGGTTTTTTGCTGAAAGGAGGAACTATATCCGGAGCGACTCCACGGCGACTTGGCAAGCTCG
      AACTCCCAAAAAACGACTTTCCTCCTTGATATAGGCCTCGCTGAGGGTGCCGTGCAACCGTTCGAGC
             1570      1580      1590      1600      1610      1620

FIG. 101 (Continued)
```

FIG. 102 - Exemplary Expression Construct for csUBP7_95C_bZif

```
        270                     280                      290                        300
  V  D  T  P  E  N  K  E  F  V  E  K  Y  K  K  K  Y  G  E  D  R  V  T  D  D  P  I  E  A  A  Y  I  G  V  Y  L  W  A  K  A
TGTAGATACACCCGGAAAACAAGGAGTTCGTTGAGAAGTATAAGAAAAAGTATGGGAGGAGGACCGGGTGACAGATGACCCAATCGAGGCGGGCATACATCGGCGGCTATACTTATGGGCTAAAGC
ACATCTATGTGGCCTTTTGTTCCTCAAGCAACTCTTTATATTCTTTTCATACACCCTCCTGGCCCACTGTCTACTGGGTTAGCTCCGCCGTATGTAGCCGCATATGAATACCCGATTTCG
   970       980       990      1000      1010      1020      1030      1040      1050      1060      1070      1080

310                     320                      330                        340
  V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACAGACGTGGATAAGGTCCGGGAGGCGGCCAAAGGCATCGAATTTAACGCCCCAGAGGGCCCAGTGAAGATTGACGGCGACAACCAGCACCTCTACAAGAC
CCAACTCTTCCGCCCCAGCTGTCTGCACCTATTCCAGGCCCTCCGCGGACTTCCGGGTCATTCTAACTGCGCGGCTGTGGTCGTGGAGATGTTCTG
  1090      1100      1110      1120      1130      1140      1150      1160      1170      1180      1190      1200

350                     360                      370                        380
  V  R  I  G  E  I  L  E  N  G  Q  I  R  E  L  W  K  T  N  K  P  V  K  P  D  P  Y  L  K  G  Y  E  W  A  Q  G  L  S  E  Q
GGTGCGTATTCGTGAGATCTGGAGAACGGTCAAATTCGTGAGTTGTGGAAAACAAATAAACCAGTTAAACCAGATCCATATTTAAAAGGTTATGAAGGTTAAAGGGCACAGGGTTAAGCGAGCA
CCACGCATAACCACTCTAGGACCTCTTGCCAGTTTAAGCACTCAACACCTTTGTTTATTGGTCTAGTATAAATTTTCAATACTTACCCGTGTCCCAATTCGCTCGT
  1210      1220      1230      1240      1250      1260      1270      1280      1290      1300      1310      1320

390                     400                      410
  G  G  S  G  G  S  T  G  E  K  P  Y  K  C  P  E  C  G  K  S  F  S  R  S  G  G  S  H  H  H  H  H  H  *
AGGCGCAGGCCAGCGACCGGCAGCACCGGGCTATAAATGTCCGGAATGTGGCAAAAGCTTTAGCCGCAGTCGGTTCACATCATCATCATCATCATTAATGAAAGGGCGATATCCA
TCCGCGTCCGGTCGCGCCCGTCGTGGCCGGGCGCCCGATATTTACAGGCCGCGTCGCCACCAAGTGTAGTAGTAGTAGTAATTACTTTCCCGCTATAGGT
  1330      1340      1350      1360      1370      1380      1390      1400      1410      1420      1430      1440

GCACACTGGCCGGCCGGCCGTTACTAGTGGATCCGGGCTGCTGCTAACAAAGCCCGAACAAGCTGAGTGGCTGCTGCCACCGCTGAGCAATAACATAACCCCTTGGGCCCTCTAAACGGGTC
CGTGTGACCGGCCGGCCGGCCAAATGATCACCTAGGCCCGACGATTGTTTCGGGCTTTCTTCGACTCAACGACGACGCGTGGCGACTCGTTATTGATCGTATTGGGAACCCCGGAGATTGCCCAG
  1450      1460      1470      1480      1490      1500      1510      1520      1530      1540      1550      1560

TTGAGGGGTTTTTGCTGAAAGGAGGAACTATATCCGGAGCGACTCCACGGCAGTTGGCAAGCTCG
AACTCCCAAAAAACGACTTTCCTCCTTGATATAGGCCTCGCTGAGGGTGCCGTGCAACCGTTCGAGC
  1570      1580      1590      1600      1610      1620

FIG. 102 (Continued)
```

FIG. 103 - Exemplary Expression Construct for csUBP7_18C.20_bzif

```
CGGTCACGCGTTGGGACTGCCATAGGCTGCCCGGTCGATGCCGGCCACGATGCGTCCGGCGATCTCGATCTCGATCGCGAAATTAATACGACTCACTATAGGGAGACCACAAC
GCCAGTGCGAACCCTGACGGTATCCGACGGCCCGGCCACTACGGCTGCTACGCGATGCTCCTAGCTCCTAGCTAGGCGCTTTAATTATGCTGAGTGATATCCCTCTGGTGTTG
          10         20         30         40         50         60         70         80         90         100        110        120

M  S  S  S  E  K  E  K  S  E  E  T  I  K  V  G  I  L  H  S  L  S
GGTTTCCCTCTAGAAATAATTTTGTTTAACTTTTAAGAGGAGATATACCTCTATATGGTACTCAAGTAGTCTTAGTCTTTTCACTTCTCTGTAGTTCATCCCTAAGAGTGTCGAACTC
CCAAAGGGAGATCTTTATTAAACAAATTGAAATTCTCCTCTATATGGTACTCAAGTAGTCTTAGTCTTTTCACTTCTCTGTAGTTCATCCCTAAGAGTGTCGAACTC
          130        140        150        160        170        180        190        200        210        220        230        240

G  T  M  S  I  S  E  V  S  L  K  D  A  E  L  M  A  I  E  E  I  N  N  G  G  V  L  G  K  K  L  E  P  I  V  E  D  G  A
TGGTACGACTGTCAATCTCAGAAGTTCCTTAAAAGATGCCGAATTAATGGCCGATCGAAGAGATCAACAATAATGGCGGTGTGTTAGTAAAAAGTTAGACCGATCGTGAAGATGGCGC
ACCATGCTACAGTTAGAGTCTTCAAGGAATTTCTACGACGGCTTAATTACCGGCTACTAGTGTTATTACCGCCACACATCCATTTTCAATCTGGCTAGCACTTGGCTAGCCCG
          250        260        270        280        290        300        310        320        330        340        350        360

S  D  W  P  T  F  A  E  K  A  K  K  L  L  Q  K  D  K  V  A  V  I  F  G  A  W  T  S  A  S  R  K  A  V  L  P  V  V  E  E
CTCAGACTGGCCCGACCTTCGCTGAAAAGGCTAAGAAGCTTTTACAGAAACTTTGAAAATGTCTTCCTGTTCCACCGTCATTAAAAGCCGCAGCGTTCGGCGTTTCGGCATGAGGGTCAGCAGCTTCT
GAGTCTGACCGGCTGGAAGCGACTTTTCGATTCTTTGAAAATGTCTTCCTGTTCCACCGTCATTAAAAGCCGCAGCGTTCGGCATGAGGGTCAGCAGCTTCT
          370        380        390        400        410        420        430        440        450        460        470        480

N  N  G  L  L  F  Y  P  V  A  Y  E  G  L  E  S  S  P  N  I  F  Y  M  G  A  A  P  N  Q  Q  I  V  P  A  V  K  W  L  F  D
AAATAATGGGCTTCTCTTCATCCGGTTCGTATGAAGGTCTGAATATCTTTTACATGGGCGCCGCCCAAACCAGCAGATCGTGCCAGCAGTTAAATGGCTCTTCGA
TTTATTACCCGAAGAGATAGGCCACGCATACTTCCAGACTTAGAGACTTCCAGAGCTTTCAAGGGGTTTCAAGGTCCAAGTCTAAGCACGGTCGTCTAGCACGGTCGTCAATTTACCGAGAAGCT
          490        500        510        520        530        540        550        560        570        580        590        600

N  G  K  K  R  F  Y  L  L  G  S  D  Y  V  F  P  R  T  A  N  K  I  I  K  A  Y  L  K  Y  L  G  G  V  V  G  E  E  Y  T
CAACGGTAAGAAGCGTTTCTACCTCTTGGGCTCGACTGTATTCCACGCACGACAAACAAGATTATTAAGGCATAACTCAAATACCTCGGCGGTGTGTAGTAGTGAAGAATACAC
GTTGCCATTCTTCGCAAAGATGGAGAACCCGAGCCTAATACATAAGGGTGCGTGTCGTTTGTTCTAATAATTCCGTATGGAGTTTATGGAGCCGCCACAACATCATCCACTCTTATGTG
          610        620        630        640        650        660        670        680        690        700        710        720

P  C  G  H  T  D  Y  S  S  V  I  N  K  I  K  A  A  K  P  D  V  V  F  N  T  L  N  G  D  S  N  V  A  F  F  K  Q  L  K  D
CCCATGTGGTCACACTGACTATAGTTCTGTCATTAATAAAATCAAAGCCCGAAAGCCAGAGCTGCAGCAGTAGCAGCGTCGTATTAACACTCTGAACACGGGATAGTAGCCTTTTTCAAGCAATTAAAGGA
GGGTACACCAGTGACTGATAATCAAGACAGTAATTATTTTAGTTCGGCGTTTCGGCGTTGCAGCATAAATTGTGAGACTTGAAGACTTGAAGACTTGAAGAAAAAGTTCGTTAATTCCT
          730        740        750        760        770        780        790        800        810        820        830        840

A  G  I  D  A  N  T  L  P  V  M  S  V  S  I  A  E  E  E  I  K  G  I  G  P  E  Y  L  K  G  H  L  V  T  W  N  Y  F  Q  S
TGCCCGGGATTGACGCAAATACACTCCCTGTCATGAGCGTGAGCATCCGCCGAGGAGGAGATCAAAGCCATTGGTCCAGAGTATTTAAAAGGTCATCTGGTCACATGAACTATTCCAAAG
ACGGGCCTAACTGCCGTTATGTGAGGGACCAGTACTCCGTAACCAGGTCTCAATAAATTTTCCAGTAGACCAGTGTACCTGATAAAAGGTTC
          850        860        870        880        890        900        910        920        930        940        950        960
```

```
       270                    280                    290                         300
V  D  T  P  E  N  K  E  F  V  E  K  Y  K  K  K  Y  G  E  D  R  V  T  D  D  P  I  E  A  A  Y  I  G  V  Y  L  W  A  K  A
TGTAGATACACCCGAAAACAAGGAGTTCGTTGAGAAGTATAAGAAAAAGTATGGGAGGACCGGGTGACAGATGACCCAATGAGGCGGCAATCGGCGTATACATCGGCGTATACTTATGGGCTAAAGC
ACATCTATGGCCTTTTGTTCCTCAAGCAACTCTTTATATTCTTTTTCATACACCCTCCTGGCCCACTGTCTACTGGGTTAGCTCCGCCGCATATGTAGCCGCATATGAATACCCGATTTCG
       970      980      990     1000     1010     1020     1030     1040     1050     1060     1070     1080
                    310                    320                    330                         340
V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACAGACGTGGATAAGGTCCGGGAGGCCGCGAAGGGCATCGAATTTAACGCCCCAGAGGGCCCAGTGAAAGATTGACGGCGACAACCAGCACCTCTACAAGAC
CCAACTCTTCCGCCCCAGCTGTCTGCAGCCTATTCCAGGCCCTCCGGCGCTTCCCGGGTCCCGGGTCATTCTAACTGCCGCTGTGGTCGTGGAGATGTTCTG
      1090     1100     1110     1120     1130     1140     1150     1160     1170     1180     1190     1200
                    350                    360                    370                         380
V  R  I  G  E  I  L  E  N  G  Q  I  R  E  L  W  K  T  N  K  P  V  K  P  D  P  Y  L  K  G  Y  E  W  A  Q  G  L  S  E  Q
GGTGCGTATTCGTGAGATCCTGGAGAACGGTCAAATTCGTGAGTTGTGGAAAACAAATAAACCAGTTAAACCAGATCCATATTTAAAAGGTTATGAATGGGCACAGGGTTAAGCGAGCA
CCACGCATAACCACTCTAGGACCTCTTGCCAGTTTAAGCACTCAACACCTTTGTTTATTTGGTCTAGTATAAAATTTTCCAATACTTACCCGTGTCCCAATTCGCTCGT
      1210     1220     1230     1240     1250     1260     1270     1280     1290     1300     1310     1320
                    390                    400                    410
G  G  S  G  G  S  T  G  E  K  P  Y  K  C  P  E  C  G  K  S  F  S  R  S  G  G  S  H  H  H  H  H  H  *
AGGCGCAGCTGGCGGCAGCACCGGCGAAAAACCGTATAAATGTCCGGAATGTGGCAAAAGCTTTAGCCGCAGTCGGTGGTTCACATCATCATCATCATTAATGAAAGGGCGATATCCA
TCCGCGTCGACCGCCGTCGTGGCCGCTTTTGGCATATTTACAGGCCGTTACACCGTTTCGAAATCGGCGTCGCCAAGTGTAGTAGTAGTAGTAATTACTTTCCCGCTATAGGT
      1330     1340     1350     1360     1370     1380     1390     1400     1410     1420     1430     1440

GCACACTGGCCGGCCGGCCGTTACTAGTAGTCACCTAGTGGATCCGGCTGCTAACAAAGCCCGAAACAAGCTGAGTGGTGGCTGCTGCCACCGCGTGAGCAATAACTAGCATAACCCCTTGGGCCTCTAAACGGGTC
CGTGTGACCGGCCGGCCAGGCCGACGATTGTTTCCGGCCTTTCTTCGACTCAACGACGACGGTTGCGACTCGTTATTGATCGTATTGGGAACCCCGGAGATTGCCCAG
      1450     1460     1470     1480     1490     1500     1510     1520     1530     1540     1550     1560

TTGAGGGGTTTTTTGCTGAAAGGAGGAACTATATCCGGAGCGACTCCACGGCAGTTGGCAAGCTCG
AACTCCCAAAAAACGACTTTCCTCCTTGATATAGGCCTCGCTGAGGGTGCCGTGCAACCGTTCGAGC
      1570     1580     1590     1600     1610     1620

FIG. 103 (Continued)
```

FIG. 104 - Exemplary Expression Construct for csUBP7_18C.114A_Imm1

```
          270               280               290              300
  V  D  T  P  E  N  K  E  F  V  E  K  Y  K  K  K  Y  G  E  D  R  V  T  D  D  P  I  E  A  A  Y  I  G  V  Y  L  W  A  K  A
TGTAGATACACCGGAAAACAAGGAGTTCGTTGAGAAGTATAAGAAAAAGTATGGGAGGACCGGGTGACAGATGACCCAATCGAGGCGGCAGATCATCGGCGGCTATACTTATGGCGCTAAAGC
ACATCTATGTGGCCTTTTGTTCCTCAAGCAACTCTTTGTATATTCTTTTTCATACCCCTCCTGGCCCACTGTCTACTGGGTTAGCTCCGCCGCCATATGAATACCCGATTTCG
      970       980       990      1000      1010      1020      1030      1040      1050      1060      1070      1080

310               320               330              340
  V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACGACGTGGATAAGGTCCGGGAGGCGGCCAAGGGCATCGAATTTAACGCCCAGAGGGCCCAGTGAAAGATTGACGGCGACAACCAGCACCTCTACAAGAC
CCAACTCTTCCGCCCCAGCTGCTGCACCTATTCCAGGCCCTCTTCCGCGGTCGCATTCTTAAATTGCGGGGTCTCCGCCTGTTGGTCGTGGAGATGTTCTG
     1090      1100      1110      1120      1130      1140      1150      1160      1170      1180      1190      1200

350               360               370              380
  V  R  I  G  E  I  L  E  N  G  Q  I  R  E  L  W  K  T  N  K  P  V  K  P  D  P  Y  L  K  G  Y  E  W  A  Q  G  L  S  E  Q
GGTCGTAGTTCGTGAGATCCTGGAGAACGGTCAAATTCGTGAGTTGTGGAAAACAAATAAACCAGTTAAACCAGATCCATATTTAAAAGGTTATGAATGGGCACAGGGTTAAGCGAGCA
CCACGCATAACCACTCTAGGACCTCTTGCCAGTTTAAGCACTCAACACCTTTGTTTATTGGTCTAGTATAAATTTTCAATACTTACCCGTGTCCCAATTCGCTCGT
     1210      1220      1230      1240      1250      1260      1270      1280      1290      1300      1310      1320

390               400
  G  G  S  K  K  K  K  K  G  S  H  H  H  H  H  H  *  *
AGGCGGCAGCAAAAAAAAAAAAAAAAGGTGGTTCACATCATCATCATCATTAATGAAAGGCCGATATCCAGCACACTGGCGGCCCGTTACTAGTGGATCCGGCTCCTAACAAAGCC
TCCCGCCCGTTCGTTTTTTTTTTTTTTCCACCAAGTGTAGTAGTAGTAGTAGTTACTTCCCGGCTATAGGTCGTGTGACCGCCGGCAATGATCATCACCTAGGCCGACGATTGTTCGG
     1330      1340      1350      1360      1370      1380      1390      1400      1410      1420      1430      1440

CGAAAGGAAGCTGAGTTGGCTGCTGCCACCGCTGCTGCCGACAGCGGTTGGCGACTGGCGACTCGTTATTGATCGATGTATTGGGGAACCCCGGAGAATTGCCCAGAACTCCCCAAAAAACGACTTTCCTCCTTGATATAGGCCTCGCTGA
GCTTTCCTTCGACTCAACGACGACGGTGGCGACGGCTGCCGCCAACCGCTGACCGCTGAGCAATAACTAGCTACATAACCCTTGGGCCTCTAAAGGTCTTGAGGGGTTTTTTGCTGAAAGGAGGAACTATATCCGGAGCGACT
     1450      1460      1470      1480      1490      1500      1510      1520      1530      1540      1550      1560

CCCACGGCACGTTGGCAAGCTCG
GGGTGCCGTGCAACCGTTCGAGC
     1570      1580

FIG. 104 (Continued)
```

FIG. 105 - Exemplary Expression Construct for csUBP7_186C.114A_Imm2

```
      270                     280                     290                     300
 V  D  T  P  E  N  K  E  F  V  E  K  Y  K  K  K  Y  G  E  D  R  V  T  D  D  P  I  E  A  A  Y  I  G  V  Y  L  W  A  K  A
TGTAGATACACCGGAAAACAAGGAGTTCGTTGAGAAGTATAAGAAAAAGTATGGGAGGAGGACCGGGTGACAGATGACCCAATCGAGGCGGCATACATCGGCGTATACTTATGGGCTAAAGC
ACATCTATGTGGCCTTTTGTTCCTCAAGCAACTCTTTTGTATTCTTTTTCATACCCCTCCTGGCCCACTGTCTACTGGGTTAGCTCCGCCGTATGTAGCCGCATATGAATACCCGATTTCG
        970                     990                    1010                    1030                    1050                    1070
     980                    1000                    1020                    1040                    1060                    1080

310                     320                     330                     340
 V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACAGACGTGGATAAGGTCCGGGAGGAGGCCGCGAAGGGCATCGAATTTAACGCCCCAGAGGGGCCCAGTGAAAGATTGACGGCGACAACCAGCACCTCTACAAGAC
CCAACTCTTCCGCCCCAGCTGTCTGCAGACGTGTCTCCAGCCTATTCCAGGCCCTCCGGCGCTTCCCGGGTCCGTCATTTCTAACTGCCCAGTCACGCCGCTGTCGTGGAGATGTTCTG
       1090                    1110                    1130                    1150                    1170                    1190
    1100                    1120                    1140                    1160                    1180                    1200

350                     360                     370                     380
 V  R  I  G  E  I  L  E  N  G  Q  I  R  E  L  W  K  T  N  K  P  V  K  P  D  P  Y  L  K  G  Y  E  W  A  Q  G  L  S  E  Q
GGTCGTATTGGTGAGATCCTGGAGAACGGTCAAATTCGTGAGTTGTGGAAAACAAATAAACCAGTTAAACCAGATCCATATTTAAAAGGTTATGAATGGGCACAGGGTTAAGCGAGCA
CCACGCATAACCACTCTAGGACCTCTTGCCAGTTTAAGCACTCAACACCTTTGTTTATTTGGTCAAGAATAAATTTTCCAATACTACCCGTGTCCCCAATTCGCTCGT
       1210                    1230                    1250                    1270                    1290                    1310
    1220                    1240                    1260                    1280                    1300                    1320

390                     400
 G  G  S  H  H  H  H  H  H  G  G  S  K  K  K  K  K  K  *  *
AGGTGGTTCACATCATCATCATCATCATGGCGGCAAAAAAAAAAAAATAATGAAAGGCCGATATCAGCACACTGGCGGCCCGTTACTAGTGGATCCGGCTCTAACAAAGCC
TCCACCAAGTGTAGTAGTAGTAGTAGTACCGCCGTTTTTTTTTTTTATTACTTTCCGGCTATAGTCGTGTGACCGCCGGCAATGATCATCCTAGGCCGACGATTGTTCGG
       1330                    1350                    1370                    1390                    1410                    1430
    1340                    1360                    1380                    1400                    1420                    1440

CGAAAGGAAGCTGAGTTGGCTGCTGCCACCGCTCGCCCTGAGCAATAACTAGCATAAACCCTTGGGGCCTCTAAACGGTCTTGAGGGGTTTTTTGCTGAAAGGAGAACTATATCCGGAGCGACT
GCTTTCCTTCGACTCAACCGACGACGGTGGCGAGCGGTGGCGATTGATCGTATCGTGAACCCCGGAGAATTGCCCAGAACTTGCCAAAAAACGACTTTCCTTCGATATAGGCCTCGCTGA
       1450                    1470                    1490                    1510                    1530                    1550
    1460                    1480                    1500                    1520                    1540                    1560

CCCACGGCACGTTGGCAAGCTCG
GGGTGCCGTGCAACCGTTCGAGC
       1570
    1580
```

FIG. 105 (Continued)

Figure 106:
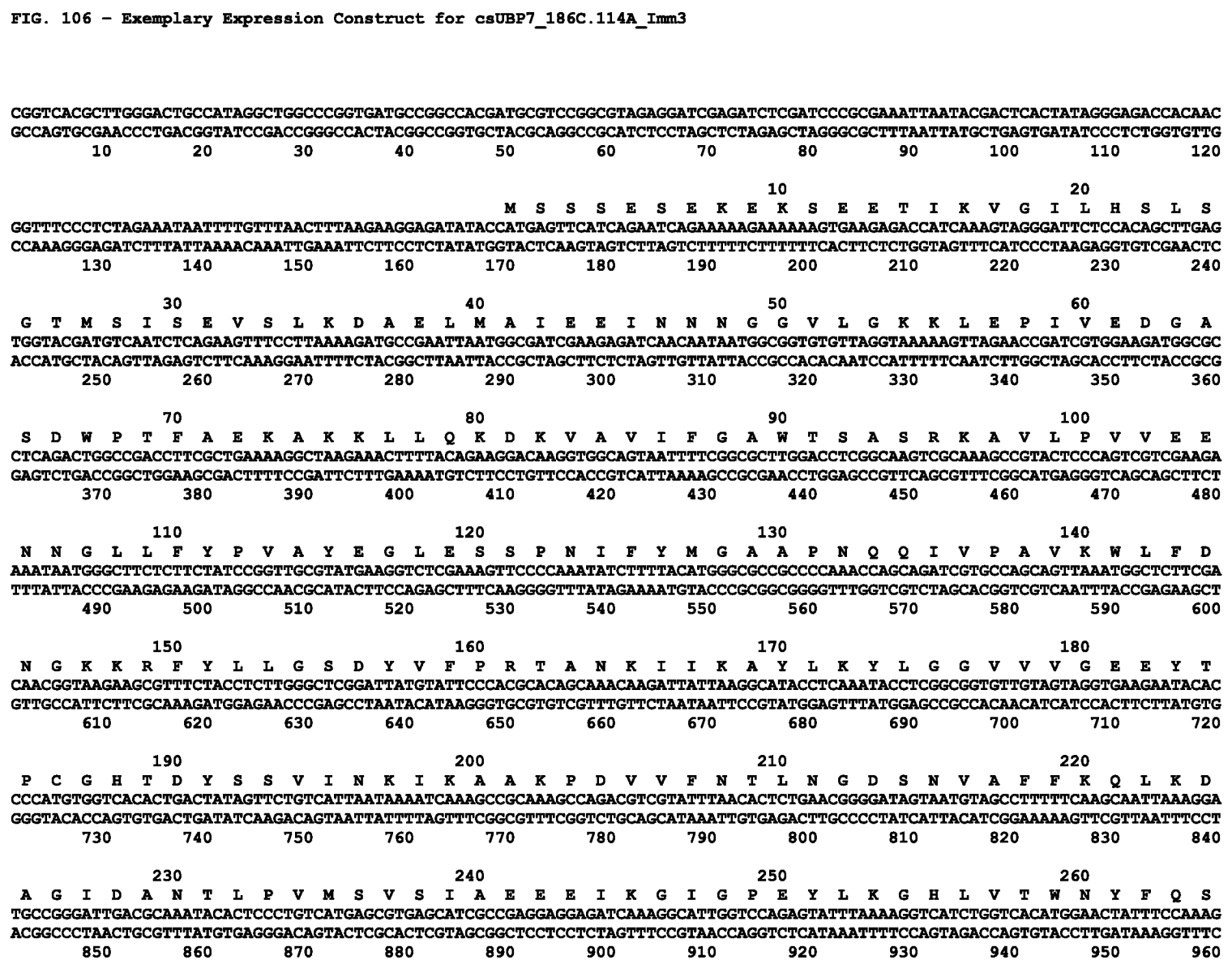

FIG. 106 - Exemplary Expression Construct for csUBP7_186C.114A_Imm3

```
CGGTCACGCTTGGGACTGCCATAGGCTGCCCCGGTGATGCGTCCGGCCACGATGCGTCGATCTCGATCCCGCGAAATTAATACGACTCACTATAGGGAGACCACAAC
GCCAGTGCGAACCCTGACGGTATCCGACGGGCCACTACGGCCGGTGCTACGCGAGCCCGCATCTCCTAGCTCCTAGAGCTAGGCGCTTTAATTATGCTGAGTGATATCCCTCGTGTTG
         10        20        30        40        50        60        70        80        90       100       110       120

```
             270                     280                       290                       300
  V  D  T  P  E  N  K  E  F  V  E  K  Y  K  K  K  Y  G  E  D  R  V  T  D  D  P  I  E  A  A  Y  I  G  V  Y  L  W  A  K  A
TGTAGATACACCGGAAAACAAGGAGTTCGTTGAGAAGTAGAAGAAAAGTATGGGAGGACCGGGTGACAGATGACCCAATGAGGCGGCATACATCGGCGGCTATACTTATGGGCTAAAGC
ACATCTATGGCCTTTTGTTCCTCAAGCAACTCTTTTATATTCTTTTTCATAGAATTCTTGGGTTAGCTCGCCGCCGCCGTATGTAGCCGCATATGAATAATACCCGATTTCG
    970       980       990      1000      1010      1020      1030      1040      1050      1060      1070      1080
              310                       320                       330                       340
  V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACAGACGTGGATAAGGTCCGGGAGGCCGCGAAAGGCATCGAATTTAACGCCCAGAGGGCCCAGTGTAAAGATTGACGGCGACAACCAGCACCTCTACAAGAC
CCAACTCTTCCGCCCCAGCTGTCTGCACCTATTCCAGGCCCTCCGGCGCTTCCGTAGCTTAAATTGCGGGGTCATTTCTAACTGCCGCTGTTGGTCGTGGAGATGTTCTG
   1090      1100      1110      1120      1130      1140      1150      1160      1170      1180      1190      1200
              350                       360                       370                       380
  V  R  I  G  E  I  L  E  N  G  Q  I  R  E  L  W  K  T  N  K  P  V  K  P  D  P  Y  L  K  G  Y  E  W  A  Q  G  L  S  E  Q
GGTCGGTATTCGTGAGATCCTGGAGAACGGTCAAATTCGTGAGTTGTGGAAAACAAATAAACCAGTTAAACCAGATCCATATTTAAAAGGTTATGAATGGGCACAGGGTTAAGCGAGCA
CCACGCCATAACCACTCTAGGACCTCTTGCCAGTTTAAGCACTCAACTCTTTTGTTTAAGCACTCAACTCTTGTCTAGTATAAATTTTCCAATACTTACCCGTGTCCCCAATTCGCTCGT
   1210      1220      1230      1240      1250      1260      1270      1280      1290      1300      1310      1320
              400
  G  G  S  H  H  H  H  H  H  G  G  S  K  K  K  K  K  K  K  K  K  *  *
AGTGGTTCACATCATCATCATCATCATGGCGGCAAATGAAAAAAAAAAAAAAAAAAAAAATGAAAGGCGATATCCAGCACTGGCGGCCGTTACTAGTGGATCCGGCT
TCCACCAAGTGTAGTAGTAGTAGTAGTACCGCCCGTTTACTTTTTTTTTTTTTTTTTATTACTTCCCGCTATAGGTCGTGACCGCCAATGATCACCTAGGCCGA
   1330      1340      1350      1360      1370      1380      1390      1400      1410      1420      1430      1440

GCTAACAAAGCCCGAAAGGAAGCTGAGTTGGCTGCTGCCACCGCTGCAATAACTAGCATAACCCCTTGGGCCTCTAAACGGGTCTTGAGGGGTTTTTTGCTGAAAGGAGGAACTATA
CGATTGTTTCGGGCTTTCGGGCTTCGACTGACTCGACTCAACCGACGACGGTGGCGACTCGTCGTTATTGATGATCGTATTGGGAACCCCGGAGAATTGCCCCAAAAAACGACTTTCCTCCTTGATAT
   1450      1460      1470      1480      1490      1500      1510      1520      1530      1540      1550      1560

TCCGGAGCGACTCCCACGGCACGTTGGCAAGCTCG
AGGCCTCGCTCGAGGGTGCCGTGCAACCGTTCGAGC
   1570      1580      1590

FIG. 106 (Continued)
```

FIG. 107 - Exemplary Expression Construct for csUBP7_186C.114A_Imm4

```
CGGTCACGCGCTTGGGACTGCCATAGGCTGCGCCGGCCGGTGATGCCGGTCCGGCGGCCACGATGCGTCTGCGGCGATGCGTCGATCCCGCGAAATTAATACGACTCACTATAGGGAGACCACAAC
GCCAGTGCGAACCCTGACGGTATCCGACGGTGCTACGCAAGGCCCATCTCCTAGCTCCAAGGCTAGGGCGCTTAATTATGCTGAGTGATATCCCTCTGGTGTTG
        10        20        30        40        50        60        70        80        90       100       110       120
                                                                    M   K   K   K   K   G   S   S   S   E   K   E   K   S   E   E   T   I   K
                                                                                                    10                      20
GGTTTCCCTCTAGAAATAATTTTGTTGTTAAACAAATTGAAATTCTTCCTCTATATGGTACTTTTTTTTTTTTTTCCGCCGTCAAGTTCATCAGAATCAGAAAGAAAAGTGAAGAGACCATCAA
CCAAAGGGAGATCTTTATTAAAACAAATACTTTAAGAAGGAGATATACCATGAAAAAAAAAAAAAAAAAAGGCGCAGTTCATCAGAATCAGAAAGAAAAGTGAAGAGACCATCAA
       130       140       150       160       170       180       190       200       210       220       230       240
 V   G   I   L   H   S   L   S   G   T   M   S   I   S   E   V   S   L   K   D   A   E   L   M   A   I   E   E   I   N   N   N   G   G   V   L   G   K   K   L
                    30                                      40                                  50                                      60
AGTAGGGATTCTCCACAGCTTGAGTGGTACGACGATGTCAATCTCAGAGAGTTCCTCTAAAAGATGCCGATGGAAGAGATCAACAAAATAATGGCGGGTGTGGTTAGGTAAAAAGTT
TCATCCCTAAGAGGTGTCGAACTTGACCATGCTGCTACAGTTAGAGTCTCAAGGAGAATTTTCTACGGTTGTTATTACCGCCACACAATCCATTTTTCAA
       250       260       270       280       290       300       310       320       330       340       350       360
 E   P   I   V   E   D   G   A   S   D   W   P   T   F   A   E   K   A   K   K   L   L   Q   K   D   K   V   A   V   I   F   G   A   W   T   S   A   S   R   K
                        70                                      80                                      90                                     100
AGAACCGATCGTGGAAGATGGCGCCTCAGACTGGCCGACCTTCGCTGAAGCTAAGAAGCTAAGAAACTTTACAGAAGGACAAGGTGCAGTAATTTTCGGCGCGCTTGGACCTCGGCAAGTCCAA
TCTTGGCTAGCACCTTCTACCGCGAGTCTGACCGGCTGGAAGCTTTCGATTCTTTGAAAATGTCTTCCTGTTCCACCGTCATTAAAAGCCCGAACCTGGAGCCGTTCAGCGTT
       370       380       390       400       410       420       430       440       450       460       470       480
 A   V   L   P   V   V   E   E   N   N   G   L   L   F   Y   P   V   A   Y   E   G   L   E   S   S   P   N   I   F   Y   M   G   A   A   P   N   Q   Q   I   V
                       110                                     120                                     130                                     140
AGCCGTACTCCCAGTCGTCGAAGAAAATAATGGGCTTCTCTTCTATCCGGTTGCGTATGAAGGTCTCGATGAAAGTCTCGAAAGTTCCCAAATATCTTTACATGGGCGCCGCCCCAAACCAGCAGATCGT
TCGGCATGAGGGTCAGCAGCTTCTTTTATTACCGAAGACGCTTGCCATTCTTCGCAAGATGGAGAAGATAGGCCAACGATACTTCAAGAGCTTTCAAGGGGTTTATAGAAAATGTACCCGCCGGCGGGGTTTGGTCGTCTAGCA
       490       500       510       520       530       540       550       560       570       580       590       600
 P   A   V   K   W   L   F   D   N   G   K   K   R   F   Y   L   L   G   S   D   Y   V   F   P   R   T   A   N   K   I   I   K   A   Y   L   K   Y   L   G   G
                       150                                     160                                     170                                     180
GCCAGCAGTTAAATGCTCTTCGACAACGGTAAGAAGCGTTTCTACCTCTTGGGCTCGGATTATGTATTCCCACGCACAGCAAACAAGATTATTAAGGCATACCTCAAATACCTCGGCGG
CGGTCGTCAATTTACCGCGAAGCTGTTGCCATTCTTCGCAAAGATGAAGAACCCGAGCACTTCCTAATACATAAGGGTGCGTGTCGTTCTAATAATTCCGTATGGAGTTATGAGCCGCC
       610       620       630       640       650       660       670       680       690       700       710       720
 V   V   V   G   E   E   Y   T   P   C   G   H   T   D   Y   S   S   V   I   N   K   I   K   A   A   K   P   D   V   V   F   N   T   L   N   G   D   S   N   V
                       190                                     200                                     210                                     220
TGTTGTAGTAGGTGAAGAATACACCCCATGGTGGTCACACTGGTCATGATCTGTCATTAATAAATCAAAGCCGAAAGCCCAGACGTCGTATTTAACACTTGTGAGACTTGCCCCTATCATTACA
ACAACATCATCCACTTCTTATGTGGGGTACACCAGTGTGACTGTGTAACAGACAGTCAAGAATCAAGACAGTAATATTTTAGTTTCAGTTTCGGTCTGCAGCAATAATGGAGACTTGCCCCTATCATTACA
       730       740       750       760       770       780       790       800       810       820       830       840
 A   F   F   K   Q   L   K   D   A   G   I   D   A   N   T   L   P   V   M   S   V   S   I   A   E   E   I   K   G   I   G   P   E   Y   L   K   G   H   L
                       230                                     240                                     250                                     260
AGCCCTTTTCAAGCAATTAAAGGATGCCGGATTGACGCAAATACACTCCCTGTCATGAGCGTGAGCATCGCCGAGGAGGAGATCAAAGGCATTGGTCCAGAGTATTTAAAAGTCATCT
TCGGGAAAAGTTCGTTAATTTCCTACGGCCCTAACTGCGTTTATGTGAGGGACAGTACTCGACACTCGTAAGTTTCCGTAACCAGTCTCATAAATTTCCAGTAGA
       850       860       870       880       890       900       910       920       930       940       950       960
```

```
                            270                         280                          290                          300
       V  T  W  N  Y  F  Q  S  V  D  T  P  E  N  K  E  F  V  E  K  Y  K  K  K  Y  G  E  D  R  V  T  D  D  P  I  E  A  A  Y  I
      GGTCACAATGGAACTATTTCAAAGTGTAGATACACCGGAAAACAAGGAGTTCGTTGAGAAATATAAGAAAAAGTATGGGGAGGACCGGGTGACAGATGACCAATCGAGGCGGCATACAT
      CCAGTGTACCTTGATAAAGTTTCACATCTATGTGGCCTTTTGTTCCTCAAGCAACTCTCTTTTATATTCTTTTTCATACCCCTCCTGGCCCACTGGGTTAGCTCCGCCGTATGTA
       970        980        990       1000       1010       1020       1030       1040       1050       1060       1070       1080

310                         320                          330                          340
       G  V  Y  L  W  A  K  A  V  E  K  A  G  S  T  D  V  D  K  V  R  E  A  A  K  G  I  E  F  N  A  P  E  G  P  V  K  I  D  G
      CGGCGTATACTTATGGGCTAAAGCGGTTGAGAAGCGGGTGACAGAGACGTGATAAGGTCCGGGAGGCATCGAATTTAACGCCCCAGAGGGCCCAGTAAAGATTGACGG
      GCCGCATATGAATACCGATTTCGCCAACTCTTCCGCCACTATTCCAGGCCCTCGTCTCCACCTATTCCAGGCGCTTCCGGTAGCTTAAATTGCGGGGTCTCCGGGTCATTCTAACTGCC
      1090       1100       1110       1120       1130       1140       1150       1160       1170       1180       1190       1200

350                         360                          370                          380
       D  N  Q  H  L  Y  K  T  V  R  I  G  E  I  L  E  N  G  Q  I  R  E  L  W  K  T  N  K  P  V  K  P  D  P  Y  L  K  G  Y  E
      CGACAACCAGCACCTCTACAAGACGGTCCGTATTGGTGAGATCCTGGAGAACGGTCAAATTCGTGAGTTGTGAAAACAAATAACCAGTTAAACCAGATTCATATTTAAAAGGTTATGA
      GCTGTTGGTCGTCGTGGAGATGTTCTGCCACGCATAACCACTCTGCCAGTTAAGCACTCAACACCTTTGTTTATTTGGTCAATTTGGTCTAGGTATAAATTTCCAATACT
      1210       1220       1230       1240       1250       1260       1270       1280       1290       1300       1310       1320

390                         400
       W  A  Q  G  L  S  E  Q  G  G  S  H  H  H  H  H  H  *  *
      ATGGGCACAGGGTTAAGCGAGCAAGGTGGTTCACATCATCATCATCATCATTAATGAAAGGGCGATATCCAGCACACTGGCCGCCGTTACTAGTAGTAGATCCGGCTGCTAACAAAGCCGA
      TACCCGTGTCCCCAATTCGCTCGTTCCACCAAGTGTAGTAGTAGTAGTAGTAATTACTTTCCCGCTATAGGTCGTGTGACCGGCAATGATCACCTAGGCCGACGATTGTTTCGGCT
      1330       1340       1350       1360       1370       1380       1390       1400       1410       1420       1430       1440

AAGGAAGCTGAGTTGGCTGCTGCTGCCACCGCTGAGCAATAACTAGCATAACCCCTTGGGCGCCCTCTAAACGGTCTTGAGGGTTTTTTGCTGAAAGGAGGAACTATATCCGGAGCGACTCCC
      TTCCTTCGACTCAACGACGACGGTGCGACTCGTTATTGATCGTATTGGGAACCCCGAGATTTGCCCAGAACTCCCCAAAAAACGACTTTCCTCCTTGATATAGCCTCGCTGAGGG
      1450       1460       1470       1480       1490       1500       1510       1520       1530       1540       1550       1560

ACGGCACGTTGGCAAGCTCG
      TGCCGTGCAACCGTTCGAGC
      1570       1580

FIG. 107 (Continued)
```

FIG. 108 - Exemplary Expression Construct for csUBP7_186C.114A_Imm5

```
CGGTCACGCTTGGGACTGCCATAGGCTGCGCCGGTGATGCGTCCGGCCACGATGCGTGAGATCTGATCCCGCGAAATTAATACGACTCACTATAGGGAGACCACAAC
GCCAGTGCGAACCCTGACGGTATCCGACCGGGCCACTACGGCTGCTACGGCCCGCATCCTCTAGAGCTAGGCGCTTTAATTATGCTGAGTGATATCCCTCTGGTGTTG
         10        20        30        40        50        60        70        80        90       100       110       120

M  K  K  K  K  K  K  K  G  G  S  S  S  E  S  E  K  E  K  S  E
GGTTTCCCTCTAGAAATAATTTGTTGTTAACTTTAAGAAGGAGATATACCATGAAAAAAAAAAAAAAAAAAAGGCGGCAGTTCATCAGAATCAGAAAAGAAAAAGTGA
CCAAAGGGAGATCTTTATTAAACAAATTGAAATTCTTCCTCTATATGGTACTTTTTTTTTTTTTTTTTTTCCGCCGTCAAGTAGTCTTAGTCTTTTCTTTTTCACT
        130       140       150       160       170       180       190       200       210       220       230       240
                                               10                20
                                                              30                                  40                50
E  T  I  K  V  G  I  L  H  S  L  S  G  T  M  S  I  S  E  V  S  L  K  D  A  E  L  M  A  I  E  E  I  N  N  G  G  V  L
AGAGACCATCAAAGTTAGGAGATTCTCCACAGCTTGAGTGGTACGATGTCAATCTCAGAAGTTCCTTAAAGATGCCGAATTAATGGCGATCGAAGAGATCAACAATGGCGGTGTGTT
TCTCTGGTAGTTTCATCCGTCAAGAGGGTGTCGAACTCACCATGCTACAGTTAGAGTCTTCAAGGAATTTTCTACGGCTTAATTACCGCTAGCTTCTCTAGTTGTTATTACCGCCACACAA
        250       260       270       280       290       300       310       320       330       340       350       360
                                                              60
                                                              70                                  80                               90                                100
G  K  K  L  E  P  I  V  E  D  G  A  S  D  W  P  T  F  A  E  K  A  K  K  L  Q  K  D  K  V  A  V  I  F  G  A  W  T  S
AGGTAAAAAGTTAGAACCGATCGTTGAAGATGGCGCCTCAGATGCCCGACCTTGCCGAACGGACACTTTACAGAAGGACTAAGAACTTTACAGAAGGACAAGGTGGCAGTAATTTTCGGCGCCTTGGACCTC
TCCATTTTCAATCTTGGCTAGCACCTTCTACCGCGAGTCGTACGCCTTGCCTGACGGCTGAACGCTGAAGCAGACTTTTCCGATTCTTTGAAAATGTCTTCCTGTTCACCGTCATTAAAAGCCGCGAACCTGGAG
        370       380       390       400       410       420       430       440       450       460       470       480
                                                                                  110                                  120                                  130                                  140
A  S  R  K  A  V  L  P  V  V  E  E  N  N  G  L  L  F  Y  P  V  A  Y  E  G  L  E  S  S  P  N  I  F  Y  M  G  A  A  P  N
GGCAAGTGCGAAAGCCGTACTCCCAGTCGTCGAAGAAGATAATAATGGCCTTCGAAGGTCTCGAATATGTTGCGTATGCAAGAAGGTCTCGAATGTTCCCAAATATCTTTACATGGGCGCCGCCCAAA
CCGTTCAGCGCTTTCGGCATGAGGGTGCAGCAGCTTCTTCTACCGGAAGCTTCCAGAGCTTATACAACGCATACTTCCAGAGTCTTCAAGGGGTTTATAGAAATGTACCCGGCGGGTTT
        490       500       510       520       530       540       550       560       570       580       590       600
                                                                                                                    150                                  160                                  170                                  180
Q  Q  I  V  P  A  V  K  W  L  F  D  N  G  K  K  R  F  Y  L  L  G  S  D  Y  V  F  P  R  T  A  N  K  I  I  K  A  Y  L  K
CCAGCAGATCGTGCCAGCAGTTAAATGGCTCTTCGACAACGGTAAACGCGTTTCTACCTCTTGGGCTCGGATTATGTATTCCACGCACAGCAAACAAGATTATTAAGGCATACTTCAA
GGTCGTCTAGCACGGTCGTCAATTAACCGAGAAGCTGTTGCCATTCTTGCCAAAGATGGAGAACCCGAGCTAATACATAAGGAGTGCGTCGTTTGTTCTAATAATTCCGTATGGAGTT
        610       620       630       640       650       660       670       680       690       700       710       720
                                                                                                                                                                          190                                  200                                  210                                  220
Y  L  G  G  V  V  V  G  E  E  Y  T  P  C  G  H  T  D  Y  S  S  V  I  N  K  I  K  A  A  K  P  D  V  V  F  N  T  L  N  G
ATACCTCGGCGGTGTTGTAGTAGGTGAAGAATACACCCCATGTGGTCACACTGACTATAGTTCTGTCATTAATAAGATCAAAGCCGCAAAGCCAGACGTCGTATTTAACACTCTGAACGG
TATGGAGCCGCCACAACATCATCCACTTCTTATGTGGGGTACACCAGTGTGACTGATATCAAGACAGTAGTATTAGTTCGGCGTTTCGGTCTGCAGCATAAATTTTAGTTCGGACTTGCC
        730       740       750       760       770       780       790       800       810       820       830       840
                                                                                                                                                                                                                                                                230                                  240                                  250                                  260
D  S  N  V  A  F  F  K  Q  L  K  D  A  G  I  D  A  N  T  L  P  V  M  S  V  S  I  A  E  E  I  K  G  P  E  Y  L
GGATAGTAATGTAGCCTTTTTCAAGCAATTAAAGGATGCCGGATTGACGCAAATACACTCCCTGTCATGAGCGCTGAGCATCGCCGAGGAGGAGATCAAAGGCATTGGTCCAGAGTATTT
CCTATCATTACATCGGAAAAAGTTCGTTAATTTCGTTAATTGCTACGCCTAACTGCGTTTATGTGAGGAGAACAGTACTGCACTCGCGACTCGTAGCGGCTCCTCCTCTAGTTCCGTAACCAGGTCTCATAAA
        850       860       870       880       890       900       910       920       930       940       950       960
```

```
                    270                 280                 290                 300
      K G H L V T W N Y F Q S V D T P E N K E F V E K Y K K K Y G E D R V T D D P I E
      AAAAGGTCATCATCTGGTCACATGGAACTATTTCCAAAGTTGATAGTAGAAACAAGGAGTTCGTTGAGAAATATAAGAAAAAGTATGGGAGGACCGGGTGACAGATGACCCAATCGA
      TTTTCCAGTAGTAGCCAGTGTACCTTGATAAAGGTTTCACAATCTATCTTTGATGCCCTTTTATATTCTTTTCATACCCTCCTGGCCCACTGTCTACTGGGTTAGCT
         970       980       990       1000      1010      1020      1030      1040      1050      1060      1070      1080

310                 320                 330                 340
      A A Y I G V Y L W A K A V E K A G S T D V D K V R E A A K G I E F N A P E G P V
      GCCGGCATACATCGGCGTATACTTATGGGCTAAAGCGGTTGAGAAGGCGGGGTCGATAAGGTTCGGGGAGGCCGCGAAGGCATCGAATTTAACGCCCCAGAGGGGCCCAGT
      CCGCCGTATGTAGCCGCATATGAATACCCGATTTCGCCAACTCTTCCGCCCCAGCTGTCTGCACCTATTCCAGGCCGCTTCCGGCGTAAATTGCGGGGTCCCGGGTCA
         1090      1100      1110      1120      1130      1140      1150      1160      1170      1180      1190      1200

350                 360                 370                 380
      K I D G D N Q H L Y K T V R I G E I L E N G Q I R E L W K T N K P V K P D P Y L
      AAAGATTGACGGCGACAACCAGCACCTCTACAAGACGGTGCGTATTGGTGAGATCCTGGAGAACGGTCAAATTCGTGAGTTGTGGAAAACAAATAAACCAGTTAAACCAGATCCATATTT
      TTTCTAACTGCCGCTGTTGGTCGTGGAGATGTTCTGCCACGCATAACCACTCTAGGACCCTCTCCAGCATCAACACCACTTTTGTTATTTGGCTTAGTATAAA
         1210      1220      1230      1240      1250      1260      1270      1280      1290      1300      1310      1320

390                 400
      K G Y E W A Q G L S E Q G G S H H H H H H * *
      AAAGGTTATGAATGGGCACAGGGTTAAGCGAGCAAGGTGGTTCACATCATCATCATCATCATTAATGAAAGGCCGATATCCAGCAGCTGGCCGCCGTTACTAGTGGATCCGGCTGCT
      TTTCCAATACTTACCCGTGTCCCCAATTCGCTCGTCGTTCCACCAAGTAGTAGTAGTAGTAATTACTTTACTTCCCGCTATAGGTCGTGACCGCCAATGATCACCTAGGCCGACGA
         1330      1340      1350      1360      1370      1380      1390      1400      1410      1420      1430      1440

AACAAAGCCCAAAGGAAGCTGAGTTGGCTGCTGCCACCGCTGAGCAATAACTAGCATAACCCTTGGGCCTCTAAACGGTCTTGAGGGGTTTTTTGCTGAAAGGAGAACTATATCC
      TTGTTTCGGGCTTTCCTTCGACTTCGACTTAAGCCGACGACGGTGGCGACTCGTTATTGATCGTATTGGGGAACCCCGAGAATTTGCCCAGAAACGACTTTCCTCCTTGATATAGG
         1450      1460      1470      1480      1490      1500      1510      1520      1530      1540      1550      1560

GGAGCGACTCCCACGCACGTTGGCAAGCTCG
      CCTCGCTGAGGGTGCCGTGCAACCGTTCGAGC
         1570      1580      1590

FIG. 108 (Continued)
```

FIG. 109 - Exemplary Expression Construct for csUBP7_186C.114A_Imm6

```
              270               280               290                300
V  D  T  P  E  N  K  E  F  V  E  K  Y  K  K  Y  G  E  D  R  V  T  D  D  P  I  E  A  A  Y  I  G  V  Y  L  W  A  K  A
TGTAGATACACCGGAAAACAAGGAGTTCTTGAGAAGTATAAGAAAAGTATAAGAATATTCTTTTCATACCCTCGGCCGGTGACAGATGACCCAATCGAGGCGGCATACTCGGCGTATACTATGGGCTAAAGC
ACATCTATGTGCCTTTTGTTCCTCAAGCAACTCTTTGTTTTCATATTCTTTTATATTCTTTTATATTCTTTACTGGGTTAGCTCCGCGTATGTAGCCGCATATGAATACCCGATTCG
    970       980       990      1000      1010      1020      1030      1040      1050      1060      1070      1080

310               320               330                340
V  E  K  A  G  S  T  D  V  D  K  V  R  E  A  A  K  G  I  E  F  N  A  P  E  G  P  V  K  I  D  G  D  N  Q  H  L  Y  K  T
GGTTGAGAAGGCGGGGTCGACAGACGTGGATAAGGTCCGGGAGGCCGCGAAGGGCATCGAATTTAACGCCCCAGAGGGCCCAGTAAAGATTGACGGCGACAACCAGCACCTCTACAAGAC
CCAACTCTTCCGCCCAGCTGTCTGCACCTATTCCAGGCCCTCCGGCGCTTCCCGTAGCTAAATTGCGGGGTCATTCTAAATTGGTCGTGGTCGTGAGATGTTCTG
   1090      1100      1110      1120      1130      1140      1150      1160      1170      1180      1190      1200

350               360               370                380
V  R  I  G  E  I  L  E  N  G  Q  I  R  E  L  W  K  T  N  K  P  V  K  P  D  P  Y  L  K  G  Y  E  W  A  Q  G  L  S  E  Q
GGTGCGTAGATCCTGGAGAATCCTGGAGAATGTCGTGAGTTGTGGAAAACAAATAAACCAGTCGATCCATATTTAAAAGGTTATGAATGGGCACAGGGGTTAAGCGAGCA
CCACGCATAACCTCTAGAGACCTCTTGCCAGTTGTTAAGCACTCAACACCTTTGTTCAATTGGTCTAGGTATAAATTTCCAATACTACCCGTGTCCCAATTCGCTCGT
   1210      1220      1230      1240      1250      1260      1270      1280      1290      1300      1310      1320

390               400               410                420
G  G  S  G  G  S  T  G  E  K  P  Y  K  C  P  E  C  G  K  S  F  S  R  S  D  H  L  S  R  H  Q  R  T  H  Q  N  K  K  G  G
AGGCGGCAGCGGCGGCAGCACCGGCGAAAACCGTATAAATGTGCCAGAATGTGGAAAAAGCTTTAGCGCCGCATCATCTGAGCGCCGCCGGTGGTGCTAGTAGTCGGGTCTTGTGGTCTTGTTTTTCCACC
TCCGCCGGTCGCCGCCGTCGTGGCCGCTTTTGGCATATTTACAGGCCTTACACCGGTCGTAGGCCGCTCCATGCATGAACTCGCCGCAGCCACCGACGATCAGATCAGATCAGAACAAAAGGTCG
   1330      1340      1350      1360      1370      1380      1390      1400      1410      1420      1430      1440

430
S  H  H  H  H  H  H  *  *
TTCACATCATCATCATCATCATTAATGAAAGGGGCGATATCCAGCACACTGGGCGGCCGTTACTAGTGGATCCGGCTGCTAACAAAGCCCGAAAGGAAGCTGAGTTGGCTGCTGCCACCGCT
AAGTGTAGTAGTAGTAGTAGTAATTACTTTCCCGCTATAGGTCGTGTGACCCGTGACCGGCTTTCGGGCTTTCTTCGACTGTTGTTGACTAACGACGCGACCGACGGTGGCGA
   1450      1460      1470      1480      1490      1500      1510      1520      1530      1540      1550      1560

GAGCAATAACTAGCATAACCCCTTGGGCCTCTAAACGGGTCTTGAGGGTTTTTTGCTGAAAGGAGGAACTATATCCGGAGCGACTCCCACGGCACGTTGGCCAAGCTCG
CTCGTTATTGATCGTATTGGGAACCCGGAGATTTGCCAGAACTTCCTCCTTGATATAGGCCTCGCTGAGGGTGCCGTGCAACCGTTCGAGC
   1570      1580      1590      1600      1610      1620      1630      1640      1650      1660      1670

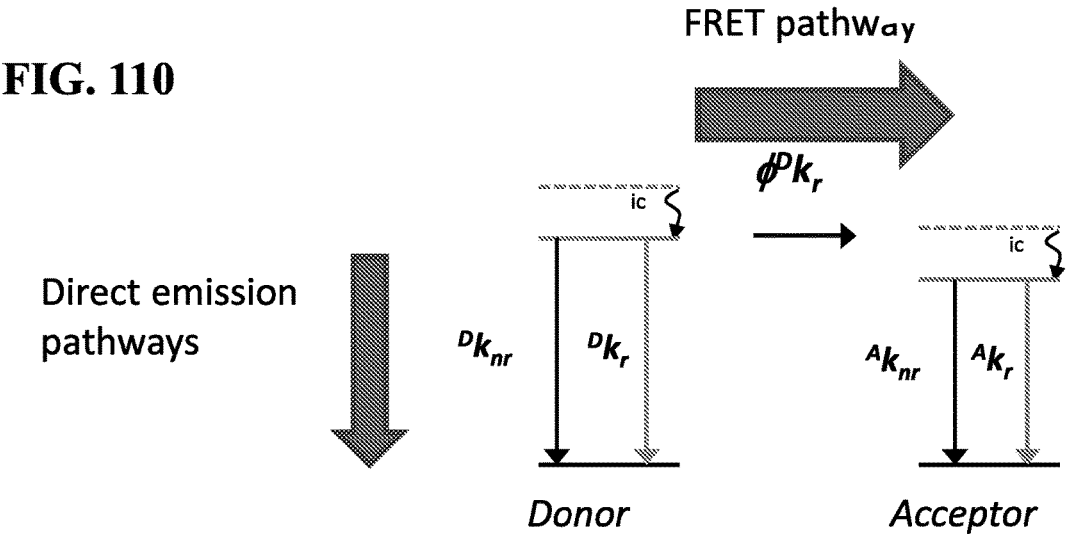

*Directly responsive partner*
- Responds directly to ligand-induced protein conformational changes
- Binds ligand (chemosensor)

Changes due to balance on photon flow in FRET and/or direct emission pathways

*Indirectly responsive partner*
No interactions with ligand of protein conformational changes
Changes only due photon flow in FRET pathway

Effects depend on role of directly responsive partner

*Donor:* Photon flow through competing output pathways
*Outputs*: Direct emission pathway (quenching) and FRET (spectral overlap) pathway

*Acceptor*
Balance of photon flow through input and output pathways
*Input:* FRET pathway (spectral overlap only)
*Output:* Direct emission pathway (quenching)

UREA BIOSENSORS AND USES THEREOF

RELATED APPLICATIONS

This application is a national stage application, filed under 35 U.S.C. § 371, of International Application No. PCT/US2016/062960 filed Nov. 19, 2016, which claims benefit of priority to U.S. Provisional Application No. 62/257,834, filed Nov. 20, 2015 and U.S. Provisional Application No. 62/257,796, filed Nov. 20, 2015, the entire contents of each of which are incorporated herein by reference.

INCORPORATION-BY-REFERENCE OF SEQUENCE LISTING

The contents of the text file named "35327-522001WO_Sequence_Listing.txt", which was created on May 16, 2018 and is 664978 bytes in size, is hereby incorporated by reference in its entirety.

FIELD OF THE INVENTION

The present invention relates to compositions and methods for detecting and determining the concentration of urea.

BACKGROUND

Urea concentrations are typically measured enzymatically with a urease. Enzyme activity is determined by measuring reaction product (protons, ammonium, and bicarbonate), either colorimetrically in coupled enzyme assays, with ion-selective electrodes, or with another physical technique. Although these assays can perform well, all are sensitive to inhibition of urease activity or alternative sources of product (e.g. pH fluctuations, dissolved $CO_2$). Some of these assays require multiple reagents (e.g. coupled enzymes) or multi-component detectors (e.g. membranes and compartments of ion-selective electrodes).

Improved sensors for urea are needed.

SUMMARY OF THE INVENTION

The compositions and methods described herein provide a solution to these and other disadvantages associated with earlier urea sensors.

Provided herein are improved biosensors that rapidly, reliably, and accurately detect and quantify urea with significant advantages over previous systems. The present disclosure provides a biosensor for urea, comprising reporter group that is attached to a urea-binding protein. The ligand comprises urea:

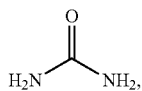

and the ligand-binding protein includes a domain or region(s) of the protein that binds the urea. The domain or region involved in ligand binding is comprised of a plurality of residues, e.g., non-contiguous amino acids of the ligand-binding protein, which are contact points or sites of contact between the ligand and its cognate ligand-binding protein. The binding of urea to the urea-binding domain of the urea-binding protein causes a change in signaling by the reporter group. In various implementations, the biosensor may produce a signal when a urea is bound to the urea binding domain that is not produced (and/or that is different from a signal that is produced) when the urea is absent from the urea binding domain. These biosensors have widespread utility including in clinical, industrial, food and beverage production and storage, and environmental settings.

A reporter group that transduces a detectable signal may be attached to the urea-binding proteins (biosensors) described herein. As used herein, "transduce" means the conversion of ligand occupancy in the binding site of a ligand-binding protein to a detectable signal. Occupancy refers to the state of ligand being bound or not bound to a cognate ligand-binding protein. In embodiments, detectable signal comprises a fluorescent, electrochemical, nuclear magnetic resonance (NMR), or electron paramagnetic resonance (EPR) signal. The reporter group is attached to the urea-binding protein so that a signal transduced by the reporter group when the urea-binding protein is bound to urea differs from a signal transduced by the reporter group when the urea-binding protein is not bound to urea. The proteins may be engineered to include a single cysteine to which the detectable label, e.g., a fluorophore is covalently attached. The biosensors are reagentless in that their monitoring mechanism requires neither additional substrates for a signal to develop, nor measurement of substrate consumption or product generation rates to determine urea concentrations.

In some embodiments, the biosensor proteins include a second fluorophore, thereby permitting ratiometric sensing/detection of an analyte using establishing non-geometrically modulated Förster resonance energy transfer (ngmFRET).

Among the advantages of these fluorophore-containing protein constructs is their high durability. The constructs retain their ability to bind urea, change shape and thus detect the analyte, urea, (a) even when immobilized (directly or indirectly) onto a solid surface such as a bead, plate, or sheet; (b) even after desiccation (and subsequent reconstitution in a physiological buffer solution); (c) even when subjected to ambient conditions, e.g., conditions that can be encountered in storage and/or transportation; and (d) even when aged/stored for extended periods of time, e.g., weeks, months, or even years. Thus, the biosensors do not require refrigeration or a cold chain for distribution, permitting a wider range of applicability such as in-the-field use and reducing the cost of the sensor product.

For clinical applications, microliter volumes (e.g., less than 0.1, 0.5, 1, 2, 3, 4, 5, 6, 7, 8, 9, or 10, or less than 10 µl) of a bodily fluid such as blood may be used. Moreover compared to conventional enzyme-based or antibody based assay systems, the results are achieved virtually instantaneously, e.g., 0.1-5 minutes, e.g., 0.1-1 minutes, or within 30-60 seconds. A further advantage is that the sensors consistently and reliably bind to and detect the analyte (urea) in complex fluids such as whole blood, plasma, serum, saliva, urine, and environmental fluids. Thus in a clinical setting, whole blood need not be processed, thereby reducing time and cost of the diagnostic procedure. Alternatively or in addition, the biosensors provided herein may be used to monitor urea levels continuously. In a non-limiting example, one or more biosensors is immobilized at the tip of a thin optical fiber to construct a urea-responsive optode. Such an optode can be introduced into the body (e.g., subcutaneously). The sensor may be in continuous contact with the sample, and excitation and emission light are passed to and from the immobilized sensor, respectively. Fluctuations in the urea sample alter the dynamic equilibrium between the open and closed states of the urea-binding protein, which is transduced into fluctuations of the fluorescent emission signal, by virtue of the sensing mechanism of the conjugated fluorophore. The emitted light intensities may be read by a reader connected to the optode.

In non-clinical situations, e.g., food and beverage composition (e.g, meat, canned food, dairy, nondairy, a fermented food, a fruit, a vegetable, a tuber, a starch, a grain, pasta, yogurt, soup, ice cream, a broth, a puree, a shake, a smoothie, a batter, a condiment, a sauce, a soft drink, a fountain beverage, water, coffee, tea, milk, a dairy-based beverages, soy-based beverage, an almond-based beverage, vegetable juice, fruit juice, a fruit juice-flavored drink, an energy drink, or an alcoholic beverage) production and/or storage, industrial, environmental (e.g., wetlands, rivers, streams, ponds, marine environments, wells, aquariums, pools, lakes, rivers, brooks, reservoirs, ground water, residential land, commercial/industrial land, agricultural land, or land abutting agricultural land), or commercial settings such as analysis of waste water, food or beverage production, or bioreactor/fermentation monitoring, the samples to be analyzed can be used directly upon sampling without further purification or processing, similarly reducing time and expense of the test. Moreover, the immobilized sensors need not be washed to remove unbound material following contacting the test sample with the sensors, because the unbound material ("contaminants") do not materially affect the production of a precise, reliable detectable assay signal.

Included herein are urea biosensors that produce a dichromatic, ratiometric signal, i.e., the signal is defined as the quotient of the intensities at two independent wavelengths. The advantage of such a signal is that it provides an internally consistent reference. The self-calibrating nature of a ratiometric measurement removes the necessity for carrying out on-board calibration tests prior to each measurement.

Thus, reagentless, fluorescently responsive urea sensors present a number of advantages over enzyme-based biosensors, including elimination of chemical transformations, elimination of substrate requirements, and self-calibration, which together lead to rapid response times, continuous monitoring capabilities, simple sample-handling, and lower cost due to simplified manufacturing and distribution processes.

Urea-Binding Proteins

Aspects of the present subject matter provide biosensors comprising a ligand-binding protein that binds urea (i.e., a urea-binding protein). Typically, a natural urea-binding protein has a urea dissociation constant ($K_d$) of about 10 µM or less at room temperature. However, urea-binding proteins may be selected, designed, or engineered (e.g., via mutation) to have a different affinity for urea (e.g., to detect higher or lower levels of urea). In various embodiments, a urea-binding protein has a $K_d$ for urea in the millimolar, micromolar, nanomolar, picomolar, or femtomolar range. For example, a urea-binding protein may have a $K_d$ for urea of at least about 0.00001 mM, 0.0001 mM, 0.001 mM, 0.1 mM, 0.5 mM, 1 mM, 2 mM, 3 mM, 4 mM, 5 mM, 6 mM, 7 mM, 8 mM, 9 mM, 10 mM, 15 mM, 20 mM, 25 mM, 50 mM, 75 mM, 100 mM, 125 mM, 150 mM, 175 mM, or 200 mM, and/or less than about 0.00001 mM, 0.0001 mM, 0.001 mM, 0.1 mM, 0.5 mM, 1 mM, 2 mM, 3 mM, 4 mM, 5 mM, 6 mM, 7 mM, 8 mM, 9 mM, 10 mM, 15 mM, 20 mM, 25 mM, 50 mM, 75 mM, 100 mM, 125 mM, 150 mM, 175 mM, or 200 mM. In some embodiments, a urea-binding protein has a $K_d$ for urea below (less than about 2 mM), within (about 2 mM to about 7 mM), or above (greater than about 7 mM) the normal range of urea in human blood. See, e.g., Deepak A. Rao; Le, Tao; Bhushan, Vikas (2007). First Aid for the USMLE Step 1 2008 (First Aid for the Usmle Step 1). McGraw-Hill Medical, as well as, Normal Lab Results from Marshal University School of Medicine, the entire content of each of which is incorporated herein by reference.

In various embodiments, the urea-binding protein has a higher affinity (lower $K_d$) for urea than for acetamide. In various embodiments, the affinity of the urea-binding protein for urea is at least about 5-fold, 6-fold, 7-fold, 8-fold, 9-fold, 10-fold, 20-fold, 30-fold, 40-fold, 50-fold, or 100-fold higher than the affinity of the urea-binding protein for acetamide.

With respect to the present subject matter, $K_d$ is the equilibrium dissociation constant between a ligand-binding protein and its ligand. $K_d$ decreases with increasing affinity, and $K_d$ may be used as an expression of affinity (the lower the value, the higher the affinity). The $K_d$ value relates to the concentration of ligand required for detectable ligand binding to occur and so the lower the $K_d$ value (lower concentration required), the higher the affinity of the ligand-binding protein for the ligand. The $K_d$ value corresponds to the ligand concentration at which the binding protein is 50% saturated.

| $K_d$ value | Molar concentration |
| --- | --- |
| $10^{-1}$ to $10^{-3}$ | Millimolar (mM) |
| $10^{-4}$ to $10^{-6}$ | Micromolar (µM) |
| $10^{-7}$ to $10^{-9}$ | Nanomolar (nM) |
| $10^{-10}$ to $10^{-12}$ | Picomolar (pM) |
| $10^{-13}$ to $10^{-15}$ | Femtomolar (fM) |

The ligand-binding proteins (as well as biosensors comprising the ligand-binding proteins) provided herein lack enzymatic activity and are not enzymes. As used herein, an "enzyme" is a protein that catalyzes a specific biochemical reaction. The ligand is not chemically altered (i.e., no chemical bond or atom of the ligand is added or removed) by the ligand-binding protein. Thus, when a ligand dissociates from a ligand-binding protein described herein, the ligand contains the same chemical structure it had before it became bound to the ligand-binding protein.

The ligand-binding protein may comprise a naturally occurring protein or a protein that is modified compared to a naturally occurring protein. For example, the ligand-binding protein may comprise one or more mutations compared to a naturally occurring protein. In some embodiments, the naturally occurring protein is a naturally occurring counterpart of the ligand-binding protein (e.g., the ligand-binding protein is a mutant of the naturally occurring counterpart).

A "naturally occurring counterpart" of a mutant polypeptide is a polypeptide produced in nature from which the mutant polypeptide has been or may be derived (e.g., by one or more mutations). For example, the naturally occurring counterpart is an endogenous polypeptide produced by an organism in nature, wherein the endogenous polypeptide typically does not have one or more of the mutations present in the mutant polypeptide. For convenience and depending on context, a naturally occurring counterpart may be referred to herein for the purpose of comparison and to illustrate the location and/or presence of one or more mutations, binding activities, and/or structural features.

As used herein, a "mutation" is a difference between the amino acid sequence of a modified polypeptide/protein and a naturally occurring counterpart. A polypeptide having a mutation may be referred to as a "mutant." Non-limiting examples of mutations include insertions, deletions, and substitutions. However, the term "mutation" excludes (i) the addition of amino acids to the N-terminus or C-terminus of a polypeptide, and (ii) the omission/deletion/replacement of a polypeptide's signal peptide (e.g., replacement with another signal peptide or with a methionine).

The addition of amino acids to the N-terminus or C-terminus of a protein via a peptide bond may be referred to herein as a "fusion" of the amino acids to the protein. Similarly, an exogenous protein fused to amino acids (e.g., another protein, a fragment, a tag, or a polypeptide moiety) at its N-terminus or C-terminus may be referred to as a "fusion protein." The added amino acids may comprise a non-native polypeptide, e.g., a polypeptide reporter group such as a fluorescent protein, a moiety that facilitates the isolation or modification of a polypeptide, or a moiety that facilitates the attachment of a polypeptide to a substrate or surface. As used herein, "non-native" when referring to the added amino acids (e.g., a "polypeptide") of a fusion protein indicates that the polypeptide is not naturally part of the protein to which it is fused in the fusion protein. For example, the sequence of a non-native polypeptide ("added amino acids") that is fused to a protein is encoded by an organism other than the organism from which the protein is derived, is not known to be naturally encoded by any organism, or is encoded by a gene other than the wild-type gene that encodes an endogenous version of the protein.

As used herein the term "signal peptide" refers to a short (e.g., 5-30 or 10-100 amino acids long) stretch of amino acids at the N-terminus of a protein that directs the transport of the protein. In various embodiments, the signal peptide is cleaved off during the post-translational modification of a protein by a cell. Signal peptides may also be referred to as "targeting signals," "leader sequences," "signal sequences," "transit peptides," or "localization signals." In instances where a signal peptide is not defined for a urea-binding protein discussed herein, the signal peptide may optionally be considered to be, e.g., the first 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids from the N-terminus of the translated protein (compared to a protein that has not had the signal peptide removed, e.g., compared to a naturally occurring protein).

In some embodiments, the ligand-binding protein comprises 1, 2, 3, 4, 5, 6, 7, 8, 9, 10, 15, 20, 25, 30, 40, 50, 60, 70, 80, 90, 100, 1-10, 1-15, 1-20, 5-15, 5-20, 10-25, 10-50, 20-50, 25-75, 25-100 or more mutations compared to a naturally occurring protein while retaining at least about 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 99.5%, or about 100% of the activity of the naturally occurring protein. Mutations include but are not limited to substitutions, insertions, and deletions. Non-limiting examples of ligand-binding proteins may have 1, 2, 3, 4, 5, 6, 7, 8, 9, 10, 15, 20, 25, 30, 40, 50, 60, 70, 80, 90, 100, 1-10, 1-15, 1-20, 5-15, 5-20, 10-25, 10-50, 20-50, 25-75, 25-100, or more substitution mutations compared to a naturally occurring protein while retaining at least about 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 99.5%, or about 100% of the activity of the naturally occurring protein. In embodiments, at least one amino acid of the ligand-binding protein has been substituted with a cysteine. Alternatively or in addition, a ligand-binding protein may include one or more mutations that remove a cysteine, e.g., 1, 2, 3, 4, 5, 6, 7, 8, 9, 10 or more substitutions or deletions of a cysteine compared to a naturally occurring protein.

Alternatively, the ligand-binding protein is not a mutant. For example, a reporter group is fused to the N-terminus or the C-terminus of the ligand-binding protein.

In some embodiments, the reporter group is conjugated to an amino acid that is no more than about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids from the N-terminus or the C-terminus of the ligand-binding protein. In some embodiments, the reporter group is conjugated to an amino acid that is at least about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids from the N-terminus or the C-terminus of the ligand-binding protein. In some embodiments, about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids (including or not including the signal peptide) have been deleted (e.g. are absent) from the N-terminus of the protein compared to its naturally occurring counterpart. In some embodiments, less than 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids (including or not including the signal peptide) have been deleted (e.g. are absent) from the N-terminus of the protein compared to its naturally occurring counterpart. In some embodiments, about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids have been deleted (e.g. are absent) from the C-terminus of the protein compared to its naturally occurring counterpart. In some embodiments, less than 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids have been deleted (e.g. are absent) from the C-terminus of the protein compared to its naturally occurring counterpart.

In various embodiments, a ligand-binding protein may comprise a stretch of amino acids (e.g., the entire length of the ligand-binding protein or a portion comprising at least about 50, 100, 200, 250, 300, 350, or 400 amino acids) in a sequence that is at least about 90%, 91%, 92%, 93%, 94%, 95%, 96%, 97%, 98%, 99%, 99.1%, 99.2%, 99.3%, 99.4%, or 99.5% identical to an amino acid sequence of a naturally occurring protein.

In some embodiments, the mutations are conservative, and the present subject matter includes many ligand-binding proteins in which the only mutations are substitution mutations. In non-limiting examples, a ligand-binding protein has no deletions or insertions compared to a naturally occurring protein (e.g., a naturally occurring counterpart). In non-limiting examples, the urea-binding protein does not comprise a deletion or insertion compared to paAmiC, avUBP, cgUBP, mpUBP1, mhUBP2, bsUBP3, dcUBP4, gtUBP5, ctUBP6, csUBP7, taUBP8, gkUBP10, psUBP11, or teUBP12. Alternatively, a ligand-binding protein may have (i) less than about 5, 4, 3, 2, or 1 inserted amino acids, and/or (ii) less than about 5, 4, 3, 2, or 1 deleted amino acids compared to a naturally occurring protein.

In various embodiments, a naturally occurring protein to which a ligand-binding protein is compared or has been derived (e.g., by mutation, fusion, or other modification) from a prokaryotic ligand-binding protein such as a bacterial ligand-binding protein. For example, the prokaryotic ligand-binding protein is a mutant, fragment, or variant of a natural (i.e., wild-type) bacterial protein. In various embodiments, the bacterial ligand-binding protein is from a thermophilic, mesophilic, or cryophilic prokaryotic microorganism (e.g., a thermophilic, mesophilic, or cryophilic bacterium).

A microorganism is "thermophilic" if it is capable of surviving, growing, and reproducing at temperatures between 41 and 140° C. (106 and 284° F.), inclusive. In various embodiments, a thermophilic organism has an optimal growth temperature between 41 and 140° C., or that is at least about 45, 50, 55, 60, 65, 70, 75, 80, 85, 90, 95, 100, 105, 110, 115, 120, 125, 130, 135, or 140° C. Many thermophiles are archaea. Thermophilic eubacteria are suggested to have been among the earliest bacteria. Thermophiles are found in various geothermally heated regions of the Earth, such as hot springs and deep sea hydrothermal vents, as well as decaying plant matter, such as peat bogs and compost. Unlike other types of microorganisms, thermophiles can survive at much hotter temperatures, whereas other bacteria would be damaged and sometimes killed if exposed to the same temperatures. Thermophiles may be classified into three groups: (1) obligate thermophiles; (2) facultative thermophiles; and (3) hyperthermophiles. Obligate thermophiles (also called extreme thermophiles) require such high temperatures for growth, whereas facultative thermophiles (also called moderate thermophiles) can thrive at high temperatures, but also at lower temperatures (e.g. below 50° C.). Hyperthermophiles are particularly extreme thermophiles for which the optimal temperatures are above 80° C. Some microorganisms can live at temperatures higher than 100° C. at large depths in the ocean where water does not boil because of high pressure. Many hyperthermophiles are also able to withstand other environmental extremes such as high acidity or radiation levels. A compound (e.g., a protein or biosensor) is "thermotolerant" if it is capable of surviving exposure to temperatures above 41° C. For example, in some embodiments a thermotolerant biosensor retains its function and does not become denatured when exposed to a temperature of about 45, 50, 55, 60, 65, 70, 75, 80, 85, 90, 95, 100, 105, 110, 115, 120, 125, 130, 135, or 140° C. for at least about 1, 2, 3, 4, 5, 6, 7, 8, 9, 10, 15, 20, 25, 30 or more minutes. In some embodiments, the thermotolerant compound survives exposure to 45, 50, 55, 60, 65, 70, 75, 80, 85, 90, 95, 100, 105, 110, 115, 120, 125, 130, 135, or 140° C. under pressure.

A microorganism is "mesophilic" if it is capable of surviving, growing, and reproducing at temperatures between 20 and 40° C. (68 and 104° F.), inclusive. "Psychrophiles" or "cryophiles" are microorganisms that are capable of growth and reproduction in cold temperatures. In various embodiments, a psychrophile is capable of growth and reproduction at a temperature of 10° C. or less, e.g., between −20° C. and +10° C.

In some embodiments, the microbial protein is produced by a bacterial microorganism, an archaean microorganism, an algal microorganism, a protozoan microorganism, or a fungal microorganism. In non-limiting examples, the microbial protein is produced by a Gram-positive bacterium or a Gram-negative bacterium. In various embodiments, a biosensor comprises a modified (e.g., mutated, fused, and/or conjugated) periplasmic binding protein or a cytoplasmic binding protein.

Aspects of the present subject matter provide a ligand-binding protein with a mutation that alters the interaction of the ligand-binding protein with a ligand (i.e. urea). For example, the ligand-binding protein comprises a mutation that alters the interaction of the ligand-binding protein with the ligand compared to a naturally occurring counterpart. In some embodiments, the ligand-binding protein comprises a mutation that alters the interaction of an amino acid of the ligand-binding protein with a water molecule compared to a naturally occurring counterpart.

In some embodiments, the ligand-binding protein does not comprise a signal peptide. For example, the signal peptide (e.g., that is present in a naturally occurring counterpart) may be replaced with a methionine.

Exemplary implementations relate to a ligand such as urea, wherein the ligand-binding protein comprises a urea-binding protein. For example, the urea-binding protein may comprise a mutant of, a fragment of, or a fusion protein comprising a microbial urea-binding protein. In embodiments, the urea-binding protein is not a mutant or fragment to which a non-native polypeptide has been attached or added. In some embodiments, the ligand-binding protein has an affinity ($K_d$) for urea within the concentration range of urea in a subject. In certain embodiments, the ligand-binding protein has an affinity ($K_d$) for urea in the range of about 0.01 mM to about 50 mM, about 0.01 mM to about 25 mM, about 0.01 mM to about 10 mM, about 0.01 mM to about 5 mM, about 0.1 mM to about 50 mM, about 0.1 mM to about 25 mM, about 0.1 mM to about 10 mM, about 0.1 mM to about 5 mM, about 1 mM to about 50 mM, about 1 mM to about 25 mM, about 1 mM to about 10 mM, or about 1 mM to about 5 mM. In various embodiments, the biosensor is capable of detecting urea when urea is present at a concentration of at least about 0.001 mM, 0.1 mM, 0.5 mM, 1 mM, 2 mM, 3 mM, 4 mM, 5 mM, 6 mM, 7 mM, 8 mM, 9 mM, 10 mM, 15 mM, 20 mM, 25 mM, 50 mM, 75 mM, 100 mM, 125 mM, 150 mM, 175 mM, or 200 mM. The ratiometric reagentless urea biosensors produce precise measurements over an extended concentration ranges, as noted above, as well as in sample volumes of less than about, e.g., 10 µl, 9 µl, 8 µl, 7 µl, 6 µl, 5 µl, 4 µl, 3 µl, 2 µl, or 1 µl. In some embodiments, the volume of sample that is applied to a biosensor or a device comprising a biosensor is less than 0.1, 0.5, 1, 2, 3, 4, 5, 6, 7, 8, 9, 10, 25, 50, 75, 100, 150, 300, 500, or 1000 µl. In some embodiments, the volume is about 0.1 µl to about 1000 µl, about 0.1 µl to about 100 µl, about 1 µl to about 1000 µl, about 1 µl to about 10 µl, about 1 µl to about 100 µl, about 1 µl to about 50 µl, about 10 µl to about 50 µl, or about 5 µl to about 50 µl. In some embodiments, the ligand-binding protein comprises a mutation that alters (e.g., increases or decreases) the interaction of the mutant with bound urea compared to a naturally occurring protein (e.g., a microbial urea-binding protein), wherein the interaction is with a portion of the urea selected from the group consisting of a first —NH$_2$ group, a second —NH$_2$ group, a carbonyl group, or any combination thereof. In non-limiting examples, the ligand-binding protein comprises a mutation that alters (e.g., increases or decreases) the mutant's affinity and/or specificity for urea compared to an unmutated ligand-binding protein (e.g., a microbial urea-binding protein). In non-limiting examples, the mutant's $K_d$ for the ligand is at least 0.001, 0.01, 0.1, 1, 2, 3, 4, 5, 6, 7, 8, 9, 10, 20, 30, 40, 50, 60, 70, 80, 90, 100, 110, 120, 130, 140, 150, 160, 170, 180, 190, or 200 mM higher or lower than the unmutated ligand-binding protein. In certain embodiments, the ligand-binding protein comprises a mutation that alters the interaction between the protein and bound urea, a mutation that alters the equilibrium between the open and closed states of the ligand-binding protein, a mutation that alters the interaction between the ligand-binding protein and a reporter group (such as a fluorescent conjugate, e.g., the interaction with Alexa532, or a carbonyl group or a naphthalene ring of a prodan-derived fluorophore such as Acrylodan or Badan), and/or a mutation that impacts indirect interactions that alter the geometry of the ligand binding site. In various embodiments, the mutation does not reduce, or negligibly impacts, the thermostability of the ligand-binding protein. In some embodiments, the mutation alters the thermostability of the ligand-binding protein by less than about 1, 2, 3, 4, 5, or 10° C. In some embodiments, the naturally occurring counterpart of the ligand-binding protein is from a Gram-positive bacterium or a Gram-negative bacterium. Non-limiting examples of Gram-negative bacteria include *Marinomonas* sp., *Marinobacter* sp., *Thermocrinis* sp., *Synechoccus* sp., and *Thermosynechococcus* sp. Non-limiting examples of Gram-positive bacteria include *Bacillus* sp., *Desulfotomaculum* sp., *Geobacillus* sp., *Clostridium* sp., *Caldicellulosiruptor* sp., and *Paenibacillus* sp.

In various embodiments, the urea-binding protein is purified.

The present subject matter provides a urea-binding protein that is or is a mutant of: an *Marinomonas* sp. (e.g., *M. posidonica*) urea-binding protein; a *Marinobacter* sp. (e.g., *M. adhaerens, M. algicola, M. alkaliphilus, M. antarcticus, M. arcticus, M. aromaticivorans, M. bryozoorum, M. daepoensis, M. daqiaonensis, M. excellens, M. flavimaris, M. gudaonensis, M. guineae, M. halophilus, M. gudaonensis, M. hydrocarbonoclasticus, M. koreensis, M. lacisalsi, M. lipolyticus, M. litoralis, M. lutaoensis, M. maritimus, M. mobilis, M. nitratireducens, M. oulmenensis, M. pelagius, M. persicus, M. psychrophilus, M. nanhaiticus, M. salarius, M. salicampi, M. salsuginis, M. santoriniensis, M. sediminum, M. segnicrescens, M. shengliensis, M. squalenivorans, M. similis, M. szutsaonensis, M. vinifirmus, M. xestospongiae, M. zhanjiangensis,* or *M. zhejiangensis*) urea-binding protein; a *Bacillus* sp. (e.g., *B. acidiceler, B. acidicola, B. acidiproducens, B. acidocaldarius, B. acidoterrestris, B. aeolius, B. aerius, B. aerophilus, B. agaradhaerens, B. agri, B. aidingensis, B. akibai, B. alcalophilus, B. algicola, B. alginolyticus, B. alkalidiazotrophicus, B. alkalinitrilicus, B. alkalisediminis, B. alkalitelluris, B. altitudinis, B. alveayuensis, B. alvei, B. amyloliquefaciens, B. a.* subsp. *amyloliquefaciens, B. a.* subsp. *plantarum, B. amylolyticus, B. andreesenii, B. aneurinilyticus, B. anthracis, B. aquimaris, B. arenosi, B. arseniciselenatis, B. arsenicus, B. aurantiacus, B. arvi, B. aryabhattai, B. asahii, B. atrophaeus, B. axarquiensis, B. azotofixans, B. azotoformans, B. badius, B. barbaricus, B. bataviensis, B. beijingensis, B. benzoevorans, B. beringensis, B. berkeleyi, B. beveridgei, B. bogoriensis, B. boroniphilus, B. borstelensis, B. brevis, B. butanolivorans, B. canaveralius, B. carboniphilus, B. cecembensis, B. cellulosilyticus, B. centrosporus, B. cereus, B. chagannorensis, B. chitinolyticus, B. chondroitinus, B. choshinensis, B. chungangensis, B. cibi, B. circulans, B. clarkii, B. clausii, B. coagulans, B. coahuilensis, B. cohnii, B. composti, B. curdlanolyticus, B. cycloheptanicus, B. cytotoxicus, B. daliensis, B. decisifrondis, B. decolorationis, B. deserti, B. dipsosauri, B. drentensis, B. edaphicus, B. ehimensis, B. eiseniae, B. enclensis, B. endophyticus, B. endoradicis, B. farraginis, B. fastidiosus, B. fengqiuensis, B. firmus, B. Plexus, B. foraminis, B. fordii, B. formosus, B. fortis, B. fumarioli, B. funiculus, B. fusiformis, B. galactophilus, B. galactosidilyticus, B. galliciensis, B. gelatini, B. gibsonii, B. ginsengi, B. ginsengihumi, B. ginsengisoli, B. globisporus, B. g.* subsp. *globisporus, B. g.* subsp. *marinus, B. glucanolyticus, B. gordonae, B. gottheilii, B. graminis, B. halmapalus, B. haloalkaliphilus, B. halochares, B. halodenitrificans, B. halodurans, B. halophilus, B. halosaccharovorans, B. hemicellulosilyticus, B. hemicentroti, B. herbersteinensis, B. horikoshii, B. horneckiae, B. horti, B. huizhouensis, B. humi, B. hwajinpoensis, B. idriensis, B. indicus, B. infantis, B. infernus, B. insolitus, B. invictae, B. iranensis, B. isabeliae, B. isronensis, B. jeotgali, B. kaustophilus, B. kobensis, B. kochii, B. kokeshiiformis, B. koreensis, B. korlensis, B. kribbensis, B. krulwichiae, B. laevolacticus, B. larvae, B. laterosporus, B. lautus, B. lehensis, B. lentimorbus, B. lentus, B. licheniformis, B. ligniniphilus, B. litoralis, B. locisalis, B. luciferensis, B. luteolus, B. luteus, B. macauensis, B. macerans, B. macquariensis, B. macyae, B. malacitensis, B. mannanilyticus, B. marisflavi, B. marismortui, B. marmarensis, B. massiliensis, B. megaterium, B. mesonae, B. methanolicus, B. methylotrophicus, B. migulanus, B. mojavensis, B. mucilaginosus, B. muralis, B. murimartini, B. mycoides, B. naganoensis, B. nanhaiensis, B. nanhaiisediminis, B. nealsonii, B. neidei, B. neizhouensis, B. niabensis, B. niacini, B. novalis, B. oceanisediminis, B. odysseyi, B. okhensis, B. okuhidensis, B. oleronius, B. oryzaecorticis, B. oshimensis, B. pabuli, B. pakistanensis, B. pallidus, B. pallidus, B. panacisoli, B. panaciterrae, B. pantothenticus, B. parabrevis, B. paraflexus, B. pasteurii, B. patagoniensis, B. peoriae, B. persepolensis, B. persicus, B. pervagus, B. plakortidis, B. pocheonensis, B. polygoni, B. polymyxa, B. popilliae, B. pseudalcalophilus, B. pseudofirmus, B. pseudomycoides, B. psychrodurans, B. psychrophilus, B. psychrosaccharolyticus, B. psychrotolerans, B. pulvifaciens, B. pumilus, B. purgationiresistens, B. pycnus, B. qingdaonensis, B. qingshengii, B. reuszeri, B. rhizosphaerae, B. rigui, B. ruris, B. safensis, B. salarius, B. salexigens, B. saliphilus, B. schlegelii, B. sediminis, B. selenatarsenatis, B. selenitireducens, B. seohaeanensis, B. shacheensis, B. shackletonii, B. siamensis, B. silvestris, B. simplex, B. siralis, B. smithii, B. soli, B. solimangrovi, B. solisalsi, B. songklensis, B. sonorensis, B. sphaericus, B. sporothermodurans, B. stearothermophilus, B. stratosphericus, B. subterraneus, B. subtilis, B. s.* subsp. *inaquosorum, B. s.* subsp. *spizizenii, B. s.* subsp. *subtilis, B. taeanensis, B. tequilensis, B. thermantarcticus, B. thermoaerophilus, B. thermoamylovorans, B. thermocatenulatus, B. thermocloacae, B. thermocopriae, B. thermodenitrificans, B. thermoglucosidasius, B. thermolactis, B. thermoleovorans, B. thermophilus, B. thermoruber, B. thermosphaericus, B. thiaminolyticus, B. thioparans, B. thuringiensis, B. tianshenii, B. trypoxylicola, B. tusciae, B. validus, B. vallismortis, B. vedderi, B. velezensis, B. vietnamensis, B. vireti, B. vulcani, B. wakoensis, B. weihenstephanensis, B. xiamenensis, B. xiaoxiensis,* or *B. zhanjiangensis*) urea-binding protein; a *Desulfotomaculum* sp. (e.g., *D. ruminis, D. nigrificans, D. australicum, D. thermobenzoicum, D. geothermicum, D. thermocisternum, D. aeronauticum, D. halophilum, D. kuznetsovii, D. thermoacetoxidans, D. thermosapovorans, D. acetoxidans, D. reducens, D. putei, D. luciae, D. gibsoniae, D. sapomandens, D. alkaliphilum, D.* sp. FSB6, *D.* sp. ASRB-Zg, *D.* sp. 175, *D.* sp. 176, *D.* sp. 171, *D.* sp. C40-3, *D.* sp. TPOSR, *D.* sp. WW1, *D.* sp. SRB-M, *D.* sp. Mechichi-2001, *D. solfataricum, D.* sp. ECP-C5, *D.* sp. MPNeg1, *D.* sp. Ox39, *D.* sp. RL50L1, *D. alcoholivorax, D.* sp. NC402, *D.* sp. NB401, *D.* sp. NA401, *D. salinum, D. carboxydivorans, D. arcticum, D. thermo-* subterraneum, D. indicum, D. sp. Lac2, D. sp. CYP1, D. sp. CYP9, D. sp. IS3205, D. sp. Srb55, D. sp. Iso-W2, D. sp. 2, D. hydrothermale, D. sp. ADR22, D. sp. Hbr7, D. sp. JD175, D. sp. JD176, D. sp. DSM 7440, D. sp. DSM 7474, D. sp. DSM 7475, D. sp. DSM 7476, D. sp. DSM 8775, D. sp. cs1-2, or D. sp. MJ1) urea-binding protein; a *Geobacillus* sp. (e.g., *G. thermoglucosidasius, G. stearothermophilus, G. jurassicus, G. toebii*) urea-binding protein; a *Clostridium* sp. (e.g., *C. absonum, C. aceticum, C. acetireducens, C. acetobutylicum, C. acidisoli, C. aciditolerans, C. acidurici, C. aerotolerans, C. aestuarii, C. akagii, C. aldenense, C. aldrichii, C. algidicarni, C. algidixylanolyticum, C. algifaecis, C. algoriphilum, C. alkalicellulosi, C. aminophilum, C. aminovalericum, C. amygdalinum, C. amylolyticum, C. arbusti, C. arcticum, C. argentinense, C. asparagiforme, C. aurantibutyricum, C. autoethanogenum, C. baratii, C. barkeri, C. bartlettii, C. beijerinckii, C. bifermentans, C. bolteae, C. bornimense, C. botulinum, C. bowmanii, C. bryantii, C. butyricum, C. cadaveris, C. caenicola, C. caminithermale, C. carboxidivorans, C. carnis, C. cavendishii, C. celatum, C. celerecrescens, C. cellobioparum, C. cellulofermentans, C. cellulolyticum, C. cellulosi, C. cellulovorans, C. chartatabidum, C. chauvoei, C. chromiireducens, C. citroniae, C. clariflavum, C. clostridioforme, C. coccoides, C. cochlearium, C. colletant, C. colicanis, C. colinum, C. collagenovorans, C. cylindrosporum, C. difficile, C. diolis, C. disporicum, C. drakei, C. durum, C. esterticheticum, C. esterticheticum esterticheticum, C. esterticheticum laramiense, C. fallax, C. felsineum, C. fervidum, C. fimetarium, C. formicaceticum, C. frigidicarnis, C. frigoris, C. ganghwense, C. gasigenes, C. ghonii, C. glycolicum, C. glycyrrhizinilyticum, C. grantii, C. haemolyticum, C. halophilum, C. hastiforme, C. hathewayi, C. herbivorans, C. hiranonis, C. histolyticum, C. homopropionicum, C. huakuii, C. hungatei, C. hydrogeniformans, C. hydroxybenzoicum, C. hylemonae, C. jejuense, C. indolis, C. innocuum, C. intestinale, C. irregulare, C. isatidis, C. josui, C. kluyveri, C. lactatifermentans, C. lacusfryxellense, C. laramiense, C. lavalense, C. lentocellum, C. lentoputrescens, C. leptum, C. limosum, C. litorale, C. lituseburense, C. ljungdahlii, C. lortetii, C. lundense, C. magnum, C. malenominatum, C. mangenotii, C. mayombei, C. methoxybenzovorans, C. methylpentosum, C. neopropionicum, C. nexile, C. nitrophenolicum, C. novyi, C. oceanicum, C. orbiscindens, C. oroticum, C. oxalicum, C. papyrosolvens, C. paradoxum, C. paraperfringens, C. paraputrificum, C. pascui, C. pasteurianum, C. peptidivorans, C. perenne, C. perfringens, C. pfennigii, C. phytofermentans, C. piliforme, C. polysaccharolyticum, C. populeti, C. propionicum, C. proteoclasticum, C. proteolyticum, C. psychrophilum, C. puniceum, C. purinilyticum, C. putrefaciens, C. putrificum, C. quercicolum, C. quinii, C. ramosum, C. rectum, C. roseum, C. saccharobutylicum, C. saccharogumia, C. saccharolyticum, C. saccharoperbutylacetonicum, C. sardiniense, C. sartagoforme, C. scatologenes, C. schirmacherense, C. scindens, C. septicum, C. sordellii, C. sphenoides, C. spiroforme, C. sporogenes, C. sporosphaeroides, C. stercorarium, C. stercorarium leptospartum, C. stercorarium stercorarium, C. stercorarium thermolacticum, C. sticklandii, C. straminisolvens, C. subterminale, C. sufflavum, C. sulfidigenes, C. symbiosum, C. tagluense, C. tepidiprofundi, C. termitidis, C. tertium, C. tetani, Clostridium tetanomorphum, C. thermaceticum, C. thermautotrophicum, C. thermoalcaliphilum, C. thermobutyricum, C. thermocellum, C. thermocopriae, C. thermohydrosulfuricum, C. thermolacticum, C. thermopalmarium, C. thermopapyrolyticum, C. thermosaccharolyticum, C. thermosuccinogenes, C. thermosulfurigenes, C.* thiosulfatireducens, C. tyrobutyricum, C. uliginosum, C. ultunense, C. villosum, C. vincentii, C. viride, C. xylanolyticum,* or *C. xylanovorans*) urea-binding protein; a *Caldicellulosiruptor* sp. (e.g., *C. acetigenus, C. bescii, C. changbaiensis, C. hydrothermalis, C. kristjanssonii, C. kronotskyensis, C. lactoaceticus, C. owensensis,* or *C. saccharolyticus*) urea-binding protein; a *Thermocrinis* sp. (e.g., *T. ruber, T. albus,* or *T. minervae*) urea-binding protein; a *Synechoccus* sp. (e.g., *S. ambiguus, S. arcuatus* var. *calcicolus, S. bigranulatus, S. brunneolus S. caldarius, S. capitatus, S. carcerarius, S. elongatus, S. endogloeicus, S. epigloeicus, S. ferrunginosus, S. intermedius, S. koidzumii, S. lividus, S. marinus, S. minutissimus, S. mundulus, S. nidulans, S. rayssae, S. rhodobaktron, S. roseo-persicinus, S. roseo-purpureus, S. salinarum, S. salinus, S. sciophilus, S. sigmoideus, S. spongiarum, S. subsalsus, S. sulphuricus, S. vantieghemii, S. violaceus, S. viridissimus,* or *S. vulcanus*) urea-binding protein; a *Paenibacillus* sp. (e.g., *P. agarexedens, P. agaridevorans, P. alginolyticus, P. alkaliterrae, P. alvei, P. amylolyticus, P. anaericanus, P. antarcticus, P. assamensis, P. azoreducens, P. azotofixans, P. barcinonensis, P. borealis, P. brasilensis, P. brassicae, P. campinasensis, P. chinjuensis, P. chitinolyticus, P. chondroitinus, P. cineris, P. cookii, P. curdlanolyticus, P. daejeonensis, P. dendritiformis, P. durum, P. ehimensis, P. elgii, P. favisporus, P. glucanolyticus, P. glycanilyticus, P. gordonae, P. graminis, P. granivorans, P. hodogayensis, P. illinoisensis, P. jamilae, P. kobensis, P. koleovorans, P. koreensis, P. kribbensis, P. lactis, P. larvae, P. lautus, P. lentimorbus, P. macerans, P. macquariensis, P. massiliensis, P. mendelii, P. motobuensis, P. naphthalenovorans, P. nematophilus, P. odorifer, P. pabuli, P. peoriae, P. phoenicis, P. phyllosphaerae, P. polymyxa, P. popilliae, P. pulvifaciens, P. rhizosphaerae, P. sanguinis, P. stellifer, P. terrae, P. thiaminolyticus, P. timonensis, P. tylopili, P. turicensis, P. validus, P. vortex, P. vulneris, P. wynnii, P. xylanilyticus*) urea-binding protein; or a *Thermosynechoccus* sp. (e.g., *T. elongatus* or *T. vulcanus*) urea-binding protein.

In various embodiments, a biosensor comprises a urea-binding protein that is or is a mutant of: a urea-binding protein from *Marinomonas posidonica* (mpUBP1; SEQ ID NO: 1, 12, or 212); a urea-binding protein from *Marinobacter hydrocarbanoclasticus* (mhUBP2; SEQ ID NO: 2, 13, or 213); a urea-binding protein from *Bacillus* sp. (bsUBP3; SEQ ID NO: 3, 14, or 214); a urea-binding protein from *Desulfotomaculum carboxydivorans* (dcUBP4; SEQ ID NO: 4, 15, or 215); a urea-binding protein from *Geobacillus thermoglucosidasius* (gtUBP5; SEQ ID NO: 5, 16, or 216); a urea-binding protein from *Clostridium thermocellum* (ctUBP6; SEQ ID NO: 6, 17, or 217); a urea-binding protein from *Caldicellulosiruptor saccharolyticus* (csUBP7; SEQ ID NO: 7, 18, or 218); a urea-binding protein from *Thermocrinis albus* (taUBP8; SEQ ID NO: 8, 19, or 219); a urea-binding protein from *Geobacillus kaustophilus* (gkUBP10; SEQ ID NO: 9, 20, or 220); a urea-binding protein from *Paenibacillus* sp. (psUBP11; SEQ ID NO: 10, 21, or 221); or a urea-binding protein from *Thermosynechococcus elongatus* (teUBP12; SEQ ID NO: 11, 22, or 222).

Aspects of the present subject matter include a urea-binding protein that is or is a mutant of a protein listed in Table 6, e.g., the protein numbered 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 270, 271, 272, 273, 274, 275, 276, 277, 278, 279, 280, 281, 282, 283, 284, 285, 286, 287, 288, 289, 290, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349 in Table 6.

With regard to a defined polypeptide, % identity figures higher or lower than those provided herein will encompass various embodiments. Thus, where applicable, in light of a minimum % identity figure, a polypeptide may comprise an amino acid sequence which is at least 60%, 65%, 70%, 75%, 76%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% identical to the reference SEQ ID NO or to each of the reference SEQ ID NOs. In embodiments, the polypeptide comprises an amino acid sequence that is 100% identical to the reference SEQ ID NO. Where applicable, in light of a maximum % identity to a reference sequence, a polypeptide may comprise an amino acid sequence which is less than 75%, 70%, 65%, 60%, 59%, 58%, 57%, 56%, 55%, 54%, 53%, 52%, 51%, 50%, 49%, 48%, 47%, 46%, 45%, 44%, 43%, 42%, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, or 15% identical to the reference SEQ ID NO or to each of the reference SEQ ID NOs. In certain embodiments, a polypeptide comprises amino acids in a sequence that is preferably at least about 10%, 11%, 12%, 13%, 14%, 15%, 16%, 17%, 18%, 19%, 20%, 21%, 22%, 23%, 24%, 25%, 26%, 27%, 28%, 29%, or 30% and less than about 75%, 70%, 65%, 60%, 55%, 50%, 45%, 44%, 43%, 42%, 41%, 40%, 39%, 38%, 37%, 36%, 35%, 34%, 33%, 32%, 31%, or 30% identical to the reference SEQ ID NO or to each of the reference SEQ ID NOs. In certain embodiments, a polypeptide comprises amino acids in a sequence that is between about 10% and about 60%, 11% and about 60%, 12% and about 60%, 13% and about 60%, 14% and about 60%, 15% and about 60%, 16% and about 60%, 17% and about 60%, 18% and about 60%, 19% and about 60%, 20% and about 60%, 21% and about 60%, 22% and about 60%, 23% and about 60%, 24% and about 60%, 25% and about 60%, 26% and about 60%, 27% and about 60%, 28% and about 60%, 29% and about 60%, 30% and about 60%, about 25% and about 100%, about 25% and about 95%, about 25% and about 85%, about 25% and about 75%, about 25% and about 70%, about 25% and about 65%, 60%, about 25% and about 55%, about 25% and about 50%, about 25% and about 45%, about 25% and about 44%, about 25% and about 43%, about 25% and about 42%, about 25% and about 41%, about 25% and about 40%, about 25% and about 39%, about 25% and about 38%, about 25% and about 37%, about 25% and about 36%, about 25% and about 35%, about 25% and about 34%, about 25% and about 33%, about 25% and about 32%, about 25% and about 31%, or about 25% and about 30% identical to the reference SEQ ID NO or to each of the reference SEQ ID NOs. Non-limiting examples of reference proteins and amino acid sequences disclosed herein include:

(i) a urea-binding protein from *Marinomonas posidonica* (mpUBP1; genome, NC_015559, protein, YP_004483096.1; SEQ ID NO: 1);

(ii) a urea-binding protein from *Marinobacter hydrocarbanoclasticus* (mhUBP2; genome, NC_017067, protein, YP_005430828.1; SEQ ID NO: 2);

(iii) a urea-binding protein from *Bacillus* sp. (bsUBP3; genome, NC_017743, protein, YP_006233530.1; SEQ ID NO: 3);

(iv) a urea-binding protein from *Desulfotomaculum carboxydivorans* (dcUBP4; genome, NC_015565, protein, YP_004496535.1; SEQ ID NO: 4);

(v) a urea-binding protein from *Geobacillus thermoglucosidasius* (gtUBP5; genome, NC_015660, protein, YP_004588319.1; SEQ ID NO: 5);

(vi) a urea-binding protein from *Clostridium thermocellum* (ctUBP6; genome, NC_009012, protein, YP_001038237.1; SEQ ID NO: 6);

(vii) a urea-binding protein from *Caldicellulosiruptor saccharolyticus* (csUBP7; genome, NC_009437, protein, YP_001181243.1; SEQ ID NO: 7);

(viii) a urea-binding protein from *Thermocrinis albus* (taUBP8; genome, NC_013894, protein, YP_003473480.1; SEQ ID NO: 8);

(ix) a urea-binding protein from *Geobacillus kaustophilus* (gkUBP10; genome, NC_006510, protein, YP_147790.1; SEQ ID NO: 9);

(x) a urea-binding protein from *Paenibacillus* sp. (psUBP11; genome, NC_013406, protein, YP_003241723.1; SEQ ID NO: 10); and (xi) a urea-binding protein from *Thermosynechococcus elongatus* (teUBP12; genome, NC_004113, protein, NP_681910.1; SEQ ID NO: 11).

In some embodiments, the urea-binding protein comprises an amino acid sequence with at least 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 90, or 100% identity to 1, 2, 3, 4, 5, 6, 7, 8, 9, 10 or more urea-binding proteins disclosed herein. In certain embodiments, the urea-binding protein comprises an amino acid sequence with at least 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 90, or 100% identity to *Pseudomonas aeruginosa* AmiC negative regulator of the amiEBCDRS amidase operon (paAmiC; SEQ ID NO: 202), *Anabaena* sp. urea-binding protein (avUBP; SEQ ID NO: 226), and/or *Corynebacterium glutamicum* urea-binding protein (cgUBP; SEQ ID NO: 227).

The urea-binding proteins disclosed herein may optionally be fused (e.g., at their N-terminal and/or C-terminal ends) to a motif comprising a stretch of amino acids that facilitates the isolation or other manipulation such as conjugation to a moiety or immobilization on a substrate such as a plastic, a cellulose product such as paper, polymer, metal, noble metal, semi-conductor, or quantum dot (e.g., a fluorescent quantum dot). A non-limiting example of such a stretch of amino acids has the sequence: GGSHHHHHH (SEQ ID NO: 223). This motif is not required for, is not believed to influence or affect ligand-binding activity or signal transduction, and may be omitted from any ligand-binding protein or biosensor disclosed herein. Additionally, for every sequence disclosed herein that includes GGSHHHHHH (SEQ ID NO: 223), a corresponding sequence that is identical except that it lacks GGSHHHHHH (SEQ ID NO: 223) is also provided and intended to be disclosed. For example, each of SEQ ID NOs: 12-104 (and the non-limiting examples of other proteins used in the experiments disclosed herein) comprises this motif (SEQ ID NO: 223). Alternatively or in addition, a ligand-binding protein may be fused to a non-native polypeptide or "added amino acids" that facilitates the attachment thereof to a surface, such as the surface of a device. In some embodiments, a ligand-binding protein may be fused to a FATT hyperacidic region (SEQ ID NO: 224) and/or a sequence fragment for C3 protease (SEQ ID NO: 228). For every sequence disclosed herein that includes FATT hyperacidic region (SEQ ID NO: 224) and/or a sequence fragment for C3 protease (SEQ ID NO: 228), a corresponding sequence that is identical except that it lacks one or both of these sequences is also provided and intended to be disclosed. For example, SEQ ID NOS: 20-22 comprise these sequences.

In some embodiments, a polypeptide comprises 1, 2, 3, 4, 5, or more substitutions or deletions of a cysteine compared to the naturally occurring counterpart of the polypeptide (i.e., 1, 2, 3, 4, 5, or more native cysteines have been removed), e.g., 1, 2, 3, 4, 5, or more cysteine to alanine substitutions compared to the naturally occurring counterpart of the polypeptide. In some embodiments, all of the cysteines of a polypeptide have been deleted and/or substituted compared to its natural counterpart. In some embodiments, one or more cysteines of a polypeptide have been substituted with an alanine, a serine, or a threonine.

In embodiments, the amino acid sequence of a protein comprises no more than 1, 2, 3, 4, 5, 6, 7, 8, 9, 10, 15, 20, 25, 30, 35, 40, 45, or 50 mutations compared to its naturally occurring counterpart. In some embodiments, less than 50, 45, 40, 35, 30, 25, 20, 15, 10, 9, 8, 7, 6, 5, 4, 3, or 2 of the mutations is a deletion or insertion of 1, 2, 3, 4, or 5 or no more than 1, 2, 3, 4, or 5 amino acids. In some embodiments, 1, 2, 3, 4, 5, 6, 7, 8, 9, 10, 15, 20, 25, 30, 35, 40, 45, 50 or more of the mutations is a substitution mutation. In certain embodiments, every mutation to a protein compared to its naturally occurring counterpart is a substitution mutation. In various embodiments, 1, 2, 3, 4, 5, 6, 7, 8, 9, 10, 15, 20, 25, 30, 35, 40, 45, 50 or more or all of the mutations to a protein compared to its naturally occurring counterpart is a conservative substitution mutation.

In various embodiments, a polypeptide does not have any insertion or deletion compared to its natural counterpart, other than (optionally) the removal of the signal peptide and/or the fusion of compounds such as another polypeptide at the N-terminus or C-terminus thereof.

Ligand-Binding Proteins Comprising a Primary Complementary Surface (PCS)

The following BLAST parameters are used to identify sequence homologues of a ligand-binding protein [such as the *Pseudomonas aeruginosa* AmiC negative regulator of the amiEBCDRS amidase operon (paAmiC) or csUBP7]: (1) Expect threshold is 10.0; (2) Gap cost is Existence:11 and Extension:1; (3) The Matrix employed is BLOSUM62; (4) The filter for low complexity regions is "on." Such an alignment may be generated using the ProteinHunter program. The ProteinHunter package always executes BLAST searches, with the following command "blastall -p blastp -m 8 -b 50000 -d %s -i <INPUT FILE> -o <OUTPUT FILE>"

where <INPUT FILE> and <OUTPUT FILE> specify the input and output files, respectively for a given calculation. This command executes the BLAST alignment program for protein sequences with default parameters, intrinsically set by the program. The BLAST program version is 2.2.24.

Sequence homologues of paAmiC or csUBP7 identified using BLAST may be aligned with paAmiC or csUBP7 using ClustalW to identify homologues that share a PCS with paAmiC or csUBP7 as discussed below.

Aspects of the present subject matter provide ligand-binding proteins that share a PCS with a urea-binding protein disclosed herein. In embodiments, the PCS comprises at least about 5, 6, 7, or 8 amino acid positions used to identify a urea-binding protein.

For example, the PCS of csUBP7 may comprise positions 92, 111, 113, 114, 157, 159, 211, and 238, wherein each position is counted as in csUBP7 (SEQ ID NO: 18 or 218; in which the signal peptide has been replaced with a methionine).

In various embodiments, a protein shares a PCS with csUBP7 if the amino acid sequence of the protein has
  (i) S at the position that aligns with position 92 of csUBP7;
  (ii) Y at the position that aligns with position 111 of csUBP7;
  (iii) V, I, or L at the position that aligns with position 113 of csUBP7; and
  (iv) Q at the position that aligns with position 114 of csUBP7,
  (v) Y at the position that aligns with position 157 of csUBP7,
  (vi) Y or F at the position that aligns with position 159 of csUBP7,
  (vii) N at the position that aligns with position 211 of csUBP7, and
  (viii) S at the position that aligns with position 238 of csUBP7,
  wherein the alignment between csUBP7 (SEQ ID NO: 18 or 218) and the protein is constructed using the ClustalW alignment program.

In another non-limiting example, the PCS of paAmiC may comprise positions 85, 104, 106, 107, 150, 152, 206, and 233, wherein each position is counted as in SEQ ID NO: 202.

In some embodiments, a protein shares a PCS with paAmiC if the amino acid sequence of the protein has
  (i) S or T at the position that aligns with position 85 of paAmiC;
  (ii) W, Y, or T at the position that aligns with position 104 of paAmiC;
  (iii) T, I, Q, V, or S at the position that aligns with position 106 of paAmiC; and
  (iv) P, Q, E, F, L, Y, C, or W at the position that aligns with position 107 of paAmiC,
  (v) Y at the position that aligns with position 150 of paAmiC,
  (vi) Y, F, V, or W at the position that aligns with position 152 of paAmiC,
  (vii) V, N, G, or L at the position that aligns with position 206 of paAmiC, and
  (viii) T, S, E, M, A, or C at the position that aligns with position 233 of paAmiC,
  wherein the alignment between paAmiC (SEQ ID NO: 202) and the protein is constructed using the ClustalW alignment program.

In certain embodiments, a protein shares a PCS with paAmiC if the amino acid sequence of the protein has
  (i) S at the position that aligns with position 85 of paAmiC;

(ii) Y at the position that aligns with position 104 of paAmiC;

(iii) T or V at the position that aligns with position 106 of paAmiC; and (iv) P or Q at the position that aligns with position 107 of paAmiC, (v) Y at the position that aligns with position 150 of paAmiC, (vi) Y or F at the position that aligns with position 152 of paAmiC, (vii) V or N at the position that aligns with position 206 of paAmiC, and (viii) T or S at the position that aligns with position 233 of paAmiC, wherein the alignment between paAmiC (SEQ ID NO: 202) and the protein is constructed using the ClustalW alignment program.

In various embodiments, a protein shares a PCS with paAmiC if the amino acid sequence of the protein has (i) S at the position that aligns with position 85 of paAmiC;

(ii) Y at the position that aligns with position 104 of paAmiC;

(iii) V at the position that aligns with position 106 of paAmiC; and (iv) Q at the position that aligns with position 107 of paAmiC, (v) Y at the position that aligns with position 150 of paAmiC, (vi) Y or F at the position that aligns with position 152 of paAmiC, (vii) N at the position that aligns with position 206 of paAmiC, and (viii) S at the position that aligns with position 233 of paAmiC, wherein the alignment between paAmiC (SEQ ID NO: 202) and the protein is constructed using the ClustalW alignment program.

The ProteinHunter package always executes multiple sequence alignments with the following command "clustalw -infile=<INPUT FILE> -outfile=<OUTPUTFILE> -align-quiet"

This command executes the CLUSTALW multi-sequence alignment program for protein sequences. There are no user-specified parameter settings that alter the alignment behavior of the program. The CLUSTALW program version is 2.1.

For convenience and depending on context, a position that aligns with a stated position of paAmiC or csUBP7 may be referred to herein as "equivalent" to the stated position.

Exemplary Ligand-Binding Proteins

Various biosensors provided herein comprise urea-binding proteins, such as urea-binding proteins that have altered amino acid sequences compared to their naturally occurring counterparts. In embodiments, such proteins are conjugated to reporter groups. mpUBP1, mhUBP2, bsUBP3, dcUBP4, gtUBP5, ctUBP6, csUBP7, taUBP8, gkUBP10, psUBP11, and teUBP12 are non-limiting reference proteins with respect to urea-binding proteins. An alignment of mpUBP1, mhUBP2, bsUBP3, dcUBP4, gtUBP5, ctUBP6, csUBP7, taUBP8, gkUBP10, psUBP11, and teUBP12 is provided in FIG. 6.

In various embodiments, a urea-binding protein (or its naturally occurring counterpart) comprises (a) an amino acid sequence that is preferably (i) at least about 10%, 11%, 12%, 13%, 14%, 15%, 16%, 17%, 18%, 19%, 20%, 21%, 22%, 23%, 24%, 25%, 26%, 27%, 28%, 29%, or 30%, and (ii) less than about 100%, 99%, 95%, 90%, 85%, 80%, 75%, 70%, 65%, 60%, 55%, 50%, 45%, 44%, 43%, 42%, 41%, 40%, 39%, 38%, 37%, 36%, or 35% identical to paAmiC, avUBP, cgUBP, mpUBP1, mhUBP2, bsUBP3, dcUBP4, gtUBP5, ctUBP6, csUBP7, taUBP8, gkUBP10, psUBP11, and/or teUBP12;

(b) a stretch of at least 5, 10, or 20 amino acids having at least about 50%, 55%, 60%, 65%, 75%, 80%, 85%, 90%, or 95% identity to a stretch of consecutive amino acids including position 27 of csUBP7;

(c) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 27 of csUBP7;

(d) a stretch of amino acids in the sequence TMXIS (where X is any amino acid, or where X is A) (SEQ ID NO: 203);

(e) a stretch of at least 5, 10, or 20 amino acids having at least about 50%, 55%, 60%, 65%, 75%, 80%, 85%, 90%, or 95% identity to a stretch of consecutive amino acids including position 43 of csUBP7;

(f) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 43 of csUBP7;

(g) a stretch of amino acids in the sequence $X_1X_2X_3X_4N$ (where $X_1$ is any amino acid, or where $X_1$ is I or V; where $X_2$ is any amino acid, or where $X_2$ is E or Q; where $X_3$ is any amino acid, or where $X_3$ is E, Q, or K; and where $X_4$ is any amino acid, or where $X_4$ is I or Q) (SEQ ID NO: 204);

(h) a stretch of at least 5, 10, or 20 amino acids having at least about 50%, 55%, 60%, 65%, 75%, 80%, 85%, 90%, or 95% identity to a stretch of consecutive amino acids including position 66 of csUBP7;

(i) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 66 of csUBP7;

(j) a stretch of amino acids in the sequence $ASX_1X_2 X_3X_4$ (where $X_1$ is any amino acid, or where $X_1$ is N or D; where $X_2$ is any amino acid, or where $X_2$ is W or P; where $X_3$ is any amino acid, or where $X_3$ is P or A; and where $X_4$ is any amino acid, or where $X_3$ is T or L) (SEQ ID NO: 205);

(k) a stretch of at least 5, 10, or 20 amino acids having at least about 50%, 55%, 60%, 65%, 75%, 80%, 85%, 90%, or 95% identity to a stretch of consecutive amino acids including position 92 of csUBP7;

(l) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 92 of csUBP7;

(m) a stretch of amino acids in the sequence WTSXSRK (where X is any amino acid, or where X is A or V) (SEQ ID NO: 206);

(n) a stretch of at least 5, 10, or 20 amino acids having at least about 50%, 55%, 60%, 65%, 75%, 80%, 85%, 90%, or 95% identity to a stretch of consecutive amino acids including position 114 of csUBP7;
(o) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 114 of csUBP7;
(p) a stretch of amino acids in the sequence YPVQXEG (where X is any amino acid, or where X is F or Y) (SEQ ID NO: 207);
(q) a stretch of at least 5, 10, or 20 amino acids having at least about 50%, 55%, 60%, 65%, 75%, 80%, 85%, 90%, or 95% identity to a stretch of consecutive amino acids including position 158 of csUBP7;
(r) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 158 of csUBP7;
(s) a stretch of amino acids in the sequence YVX$_1$PRTAX$_2$ (where X$_1$ is any amino acid, or where X$_1$ is F or Y; and where X$_2$ is any amino acid, or where X$_2$ is A or T) (SEQ ID NO: 208);
(t) a stretch of at least 5, 10, or 20 amino acids having at least about 50%, 55%, 60%, 65%, 75%, 80%, 85%, 90%, or 95% identity to a stretch of consecutive amino acids including position 186 of csUBP7;
(u) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 186 of csUBP7;
(v) a stretch of amino acids in the sequence PX$_1$GX$_2$ (where X$_1$ is any amino acid, or where X$_1$ is L or F; and where X$_2$ is any amino acid, or where X$_2$ is H, N, or G) (SEQ ID NO: 209);
(w) a stretch of at least 5, 10, or 20 amino acids having at least about 50%, 55%, 60%, 65%, 75%, 80%, 85%, 90%, or 95% identity to a stretch of consecutive amino acids including position 211 of csUBP7;
(x) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 211 of csUBP7;
(y) a stretch of amino acids in the sequence TX$_1$NGDX$_2$NV (where X$_1$ is any amino acid, or where X$_1$ is L or I; and where X$_2$ is any amino acid, or where X$_2$ is S or A) (SEQ ID NO: 210);
(z) a stretch of at least 5, 10, or 20 amino acids having at least about 50%, 55%, 60%, 65%, 75%, 80%, 85%, 90%, or 95% identity to a stretch of consecutive amino acids including position 239 of csUBP7;
(aa) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 239 of csUBP7;
(bb) a stretch of amino acids in the sequence SX$_1$X$_2$EX$_3$E (where X$_1$ is any amino acid, or where X$_1$ is I or V; where X$_2$ is any amino acid, or where X$_2$ is A or G; and where X$_3$ is any amino acid, or where X$_3$ is E or Q) (SEQ ID NO: 211);
(cc) a stretch of at least 5, 10, or 20 amino acids having at least about 50%, 55%, 60%, 65%, 75%, 80%, 85%, 90%, or 95% identity to a stretch of consecutive amino acids including position 278 of csUBP7;
(dd) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 278 of csUBP7;
(ee) a stretch of at least 5, 10, or 20 amino acids having at least about 50%, 55%, 60%, 65%, 75%, 80%, 85%, 90%, or 95% identity to a stretch of consecutive amino acids including position 288 of csUBP7;
(ff) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 288 of csUBP7;
(gg) a stretch of at least 5, 10, or 20 amino acids having at least about 50%, 55%, 60%, 65%, 75%, 80%, 85%, 90%, or 95% identity to a stretch of consecutive amino acids including position 329 of csUBP7;
(hh) a cysteine substitution (compared to a naturally occurring counterpart) within a stretch of at least 5, 10, or 20 amino acids having at least about 50%, 55%, 60%, 65%, 75%, 80%, 85%, 90%, or 95% identity to a stretch of consecutive amino acids including position 329 of csUBP7;
(ii) no more than 1, 2, 3, 4, 5, 6, 7, 8, 9, 10, or 15 deleted or inserted amino acids compared to csUBP7, not including amino acids added to the N-terminus or C-terminus of the polypeptide compared to its natural counterpart, and including or not including the signal peptide of the natural counterpart of the polypeptide;
(jj) at least 5, 6, 7, 8, 9, 10, or 11, or exactly 5, 6, 7, 8, 9, 10, or 11 α-helices; and/or
(kk) at least 10, 11, 12, 13, or 14 β-strands or exactly 10, 11, 12, 13, or 14 β-strands.

In embodiments, two or more or each of features (a)-(kk) above occurs in the polypeptide in the order listed above as the amino acid sequence of the polypeptide is viewed or read from the N-terminus to the C-terminus (with additional features and/or amino acid sequences therebetween). For example, the polypeptide may have an N-terminus, followed by feature (b), (c), or (d), followed by feature (e), (f), or (g), followed by feature (h), (i), or (j), followed by feature (k), (l), or (m), followed by feature (n), (o), or (p), followed by feature (q), (r), or (s), followed by feature (t), (u), or (v), followed by feature (w), (x), or (y), followed by feature (z), (aa), or (bb), followed by feature (cc) or (dd), followed by feature (ee) or (ff), followed by feature (gg) or (hh), followed by the C-terminus.

As used herein when referring to the order of features in an amino acid read from the N terminus to the C-terminus, a first feature is "followed by" a second feature when the second feature occurs after the first feature in the amino acid sequence. The words "followed by" do not require that the second feature immediately follow or be close to the first feature. For example, the N-terminus is followed by the C-terminus.

The features listed above are not limiting and may be combined with any other relevant features disclosed herein, including those listed below.

In some embodiments the polypeptide comprises the following sequence:

TIKVG!LHSLSGTMAISEVSLK#AE$$A!EEINXXGGVLGKKIEPHEDGA

S#WPTFA#KAXKLLQX#KVAX!FGGWTSASRKAMLPVVEXNNGL$FYPVQ

%EGXESSPN!FYTGAXPNQQIVPAVXWLLX#XGXKXFFLXGSDYV%PRTA

NKIIKAQLKAXGGXXXXXGE#YTPLGHT#YST!!XKIKXXXXXKPDXXV!F

NTLNGDSNVAF%K#$KDAGIXXXDXPVMSVS!AE#EIXGIGXXXLXGHLA

XWNY%QSX#TPENKEF!XKYKXKYGXDXRVTXDPIEAX%XXVX$WAXAVX

KAGSXDXVDKVKXAAXGXEFXAPXGXVKIXGXNQHLXKTVRIGEIQX#GQ

FKEVWXSGXP!XP#PYLKXYXWAKGL wherein each
  X is, individually, any amino acid or is absent,
  ! is, individually, I or V,
  $ is, individually, L or M,
  % is, individually, F or Y, and
  #is, individually, N, D, Q, or E.

In a non-limiting example, the urea-binding polypeptide comprises an N-terminal domain and a C-terminal domain connected by a flexible hinge, with the urea-binding site (the urea-binding domain) located in the cleft between the N-terminal and the C-terminal domain.

In some embodiments, the urea-binding polypeptide comprises, from the N-terminus to the C-terminus, a first β-strand (β1), followed by a first α-helix (α1), followed by a second β-strand (β2), followed by a second α-helix (α2), followed by a third β-strand (β3), followed by a third α-helix (α3), followed by a fourth β-strand (β4), followed by a fifth β-strand (β5), followed by a fourth α-helix (α4), followed by a sixth β-strand (β6), followed by a fifth α-helix (α5), followed by a seventh β-strand (β7), followed by a sixth α-helix (α6), followed by an eighth β-strand (β8), followed by a seventh α-helix (α7), followed by a ninth β-strand (β9), followed by an eighth α-helix (α8), followed by a tenth β-strand (β10), followed by a ninth α-helix (α9), followed by a tenth α-helix (α10), followed by an eleventh α-helix (α11), followed by an eleventh β-strand (β11), followed by a twelfth β-strand (β12), followed by a thirteenth β-strand (β13) followed by a fourteenth β-strand (β14). In some embodiments, the polypeptide comprises (i) 1, 2, or 3 amino acid substitutions between β1 and α1; (ii) 1, 2, or 3 amino acid substitutions between β2 and α2; (iii) 1, 2, or 3 amino acid substitutions in α2; (iv) 1, 2, or 3 amino acid substitutions between β3 and α3; (v) 1, 2, or 3 amino acid substitutions in α3; (vi) 1, 2, or 3 amino acid substitutions between β7 and α6; (vii) 1, 2, or 3 amino acid substitutions in β6; (viii) 1, 2, or 3 amino acid substitutions in β4; (ix) 1, 2, or 3 amino acid substitutions between the β4 and β5; (x) 1, 2, or 3 amino acid substitutions in α5; (xi) 1, 2, or 3 amino acid substitutions between β8 and α7; and/or (xii) 1, 2, or 3 amino acid substitutions between β9 and α8. In some embodiments, the substitutions are conservative substitutions. In various embodiments, one or more amino acids is substituted to cysteine compared to a naturally occurring protein.

Beta sheets consist of beta strands (also β-strand) connected laterally by at least two or three backbone hydrogen bonds, forming a generally twisted, pleated sheet. A β-strand is a stretch of polypeptide chain, e.g. 3 to 20 amino acids long, with backbone in an extended conformation.

Alpha-helical and β-strand segments assignments are calculated from a three-dimensional protein structure as follows, and as described in C. A. F. Andersen, B. Rost, 2003, *Structural Bioinformatics,* 341-363, P. E. Bourne, ed., Wiley, the entire content of which is incorporated herein by reference. First for a given residue, i, the backbone trace angle, τ, is calculated, defined as the dihedral angle between the four successive $C_\alpha$ atom positions of residues in the linear protein sequence i, i+1, i+2, i+3. These values are calculated for all residues. Second, the residues that form backbone hydrogen bonds with each other are recorded. A hydrogen bond is scored if the distance between the backbone amide nitrogen and carbonyl oxygen of two different residues in the protein is calculated to be 2.5 Å or less, and if the calculated angle between the nitrogen, its amide proton, and the carbonyl is greater than 120°. A residue is deemed to be in an α-helix, if $35 \leq \tau \leq 65$, and it makes a backbone hydrogen bond with its i+4$^{th}$ neighbor in the linear amino acid sequence. It is deemed to be in a β-strand, if the absolute t value falls in the interval $120 \leq |\tau| \leq 180$ and if it makes at least one hydrogen bond with another residue with the same τ value range. Alpha-helical segments comprise at least four residues; β-strand residues comprise at least three residues.

In various embodiments, the $C_\alpha$ root-mean-square deviation (RMSD) between the backbone of the urea-binding polypeptide and paAmiC, avUBP, cgUBP, mpUBP1, mhUBP2, bsUBP3, dcUBP4, gtUBP5, ctUBP6, csUBP7, taUBP8, gkUBP10, psUBP11, and/or teUBP12 is, e.g., between about 0-3 Å, 0-1 Å, 0-1.5 Å, 0-2 Å, 0.1-3 Å, 0.5-1 Å, 0.5-1.5 Å, or 0.5-2 Å, or less than about 0.1 Å, 0.2 Å, 0.3 Å, 0.4 Å, 0.5 Å, 0.6 Å, 0.7 Å, 0.8 Å, 0.9 Å, 1.0 Å, 1.5 Å, 1.6 Å, 1.7 Å, 1.8 Å, 1.9 Å, 2.0 Å, 2.5 Å, or 3 Å. In some embodiments, the $C_\alpha$ RMSD between the N-terminal domain (i.e., the portion of the protein at the N-terminal side of the binding domain hinge) backbone of the urea-binding polypeptide and the corresponding domain of paAmiC, avUBP, cgUBP, mpUBP1, mhUBP2, bsUBP3, dcUBP4, gtUBP5, ctUBP6, csUBP7, taUBP8, gkUBP10, psUBP11, and/or teUBP12 is, e.g., between about 0-3 Å, 0-1 Å, 0-1.5 Å, 0-2 Å, 0.1-3 Å, 0.5-1 Å, 0.5-1.5 Å, or 0.5-2 Å, or less than about 0.1 Å, 0.2 Å, 0.3 Å, 0.4 Å, 0.5 Å, 0.6 Å, 0.7 Å, 0.8 Å, 0.9 Å, 1.0 Å, 1.5 Å, 1.6 Å, 1.7 Å, 1.8 Å, 1.9 Å, 2.0 Å, 2.5 Å, or 3 Å. In certain embodiments, the $C_\alpha$ RMSD between the C-terminal domain (i.e., the portion of the protein at the C-terminal side of the binding domain hinge) backbone of the urea-binding polypeptide and the corresponding domain of paAmiC, avUBP, cgUBP, mpUBP1, mhUBP2, bsUBP3, dcUBP4, gtUBP5, ctUBP6, csUBP7, taUBP8, gkUBP10, psUBP11, and/or teUBP12 is, e.g., between about 0-3 Å, 0-1 Å, 0-1.5 Å, 0-2 Å, 0.1-3 Å, 0.5-1 Å, 0.5-1.5 Å, or 0.5-2 Å, or less than about 0.1 Å, 0.2 Å, 0.3 Å, 0.4 Å, 0.5 Å, 0.6 Å, 0.7 Å, 0.8 Å, 0.9 Å, 1.0 Å, 1.5 Å, 1.6 Å, 1.7 Å, 1.8 Å, 1.9 Å, 2.0 Å, 2.5 Å, or 3 Å. Non-limiting considerations relating to the sequence and structural differences between homologous proteins are discussed in Chothia and Lesk (1986) *The EMBO Journal,* 5(4):823-826, the entire content of which is incorporated herein by reference.

Non-limiting examples of urea-binding polypeptides that are useful in biosensors provided herein include avUBP, cgUBP, mpUBP1, mhUBP2, bsUBP3, dcUBP4, gtUBP5, ctUBP6, csUBP7, taUBP8, gkUBP10, psUBP11, and teUBP12. In embodiments, a biosensor comprises a modified avUBP, cgUBP, mpUBP1, mhUBP2, bsUBP3, dcUBP4, gtUBP5, ctUBP6, csUBP7, taUBP8, gkUBP10, psUBP11, or teUBP12 polypeptide having an amino acid substitution compared to its naturally occurring counterpart, such that the polypeptide has a cysteine at position 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 270, 271, 272, 273, 274, 275, 276, 277, 278, 279, 280, 281, 282, 283, 284, 285, 286, 287, 288, 289, 290, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, or 400, or any combination of 1, 2, 3, 4, or 5 thereof, wherein the position corresponds a SEQ ID NO disclosed herein for avUBP, cgUBP, mpUBP1, mhUBP2, bsUBP3, dcUBP4, gtUBP5, ctUBP6, csUBP7, taUBP8, gkUBP10, psUBP11, or teUBP12. In embodiments, the cysteine is conjugated to a reporter group.

In various embodiments, a biosensor comprises a modified mpUBP1. In non-limiting examples, the modified mpUBP1 may comprise one or more, or any combination of the following substitutions compared to its naturally occurring counterpart: T12X, M13X, S16X, E29X, S51X, L55X, W76X, T77X, S78X, V79X, R81X, Y97X, V99X, Q100X, Y101X, E102X, Y144X, V145X, Y146X, F175X, N204X, S231X, E234X, K269X, Y273X, N282X, and T323X, where X is any amino acid, an amino acid that results in a conservative substitution, or a cysteine, and where each position is counted in mpUBP1 with the signal peptide replaced with a methionine (SEQ ID NO: 12 or 212). The sequence for mpUBP1 (SEQ ID NO: 12 or 212) comprises C75A, C385A, and C395A mutations. In some embodiments, the modified mpUBP1 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T12C, M13C, S16C, S16I, E29Q, S51C, L55C, W76C, T77C, S78C, S78A, V79C, R81C, Y97A, Y97C, V99A, V99T, V99N, V99Q, V99H, Q100C, Q1004A, Q100S, Q100N, Q100A, Q100D, Q100E, Q100H, Q100T, Q100Y, Q100M, Q100L, Y101C, E102C, E102Q, E102D, E102A, Y144A, Y144C, V145C, Y146A, Y146C, F175C, N204A, N204Q, N204S, N204D, N204E, N204H, N204T, N204L, N204C, S231A, S231N, S231Q, S231H, S231C, E234A, K269N, Y273M, N282S, and T323G.

In various embodiments, a biosensor comprises a modified mhUBP2. In non-limiting examples, the modified mhUBP2 may comprise one or more, or any combination of the following substitutions compared to its naturally occurring counterpart: T12X, M13X, S16X, E29X, S51X, L55X, W76X, T77X, S78X, V79X, R81X, Y97X, V99X, Q100X, Y101X, E102X, Y144X, V145X, Y146X, F175X, N204X, S231X, E234X, A269X, Y273X, N282X, and T323X, where X is any amino acid, an amino acid that results in a conservative substitution, or a cysteine, and where each position is counted in mhUBP2 with the signal peptide replaced with a methionine (SEQ ID NO: 13 or 213). The sequence for mhUBP2 (SEQ ID NO: 13 or 213) comprises C385A and C395A mutations. In some embodiments, the modified mhUBP2 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T12C, M13C, S16C, S16I, E29Q, S51C, L55C, W76C, T77C, S78C, S78A, V79C, R81C, Y97A, Y97C, V99A, V99T, V99N, V99Q, V99H, Q100C, Q1004A, Q100S, Q100N, Q100A, Q100D, Q100E, Q100H, Q100T, Q100Y, Q100M, Q100L, Y101C, E102C, E102Q, E102D, E102A, Y144A, Y144C, V145C, Y146A, Y146C, F175C, N204A, N204Q, N204S, N204D, N204E, N204H, N204T, N204L, N204C, S231A, S231N, S231Q, S231H, S231C, E234A, A269N, Y273M, N282S, and T323G.

In various embodiments, a biosensor comprises a modified bsUBP3. In non-limiting examples, the modified bsUBP3 may comprise one or more, or any combination of the following substitutions compared to its naturally occurring counterpart: T12X, M13X, S16X, Q29X, S51X, T55X, W76X, T77X, S78X, A79X, R81X, Y97X, V99X, Q100X, Y101X, E102X, Y143X, V144X, F145X, L172X, N197X, S224X, E227X, N262X, M266X, S274X, and G315X, where X is any amino acid, an amino acid that results in a conservative substitution, or a cysteine, and where each position is counted in bsUBP3 with the signal peptide replaced with a methionine (SEQ ID NO: 14 or 214). In some embodiments, the modified bsUBP3 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T12C, M13C, S16C, S16I, Q29E, S51C, T55C, W76C, T77C, S78C, S78A, A79C, R81C, Y97A, Y97C, V99A, V99T, V99N, V99Q, V99H, Q100C, Q100A, Q100S, Q100N, Q100A, Q100D, Q100E, Q100H, Q100T, Q100Y, Q100M, Q100L, Y101C, E102C, E102Q, E102D, E102A, Y143A, Y143C, V144C, F145A, F145C, L172C, N197A, N197Q, N197S, N197D, N197E, N197H, N197T, N197L, N197C, S224A, S224N, S224Q, S224H, S224C, E227A, N262K, M266K, S274D, and G315E.

In various embodiments, a biosensor comprises a modified dcUBP4. In non-limiting examples, the modified dcUBP4 may comprise one or more, or any combination of the following substitutions compared to its naturally occurring counterpart: T14X, M15X, S18X, E31X, S53X, T57X, W78X, T79X, S80X, A81X, R83X, Y99X, V101X, Q102X, Y103X, E104X, Y145X, V146X, F147X, L174X, N199X, S226X, E229X, K264X, K268X, D276X, and E317X, where X is any amino acid, an amino acid that results in a conservative substitution, or a cysteine, and where each position is counted in dcUBP4 with the signal peptide replaced with a methionine (SEQ ID NO: 15 or 215). In some embodiments, the modified dcUBP4 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T14C, M15C, S18C, S18I, E31Q, S53C, T57C, W78C, T79C, S80C, S80A, A81C, R83C, Y99A, Y99C, V101A, V101T, V101N, V101Q, V101H, Q102C, Q102A, Q102S, Q102N, Q102A, Q102D, Q102E, Q102H, Q102T, Q102Y, Q102M, Q102L, Y103C, E104C, E104Q, E104D, E104A, Y145A, Y145C, V146C, F147A, F147C, L174C, N199A, N199Q, N199S, N199D, N199N, N199H, N199T, N199L, N199C, S226A, S226N, S226Q, S226H, S226C, E229A, K264N, K268M, D276S, and E317G.

In various embodiments, a biosensor comprises a modified gtUBP5. In non-limiting examples, the modified gtUBP5 may comprise one or more, or any combination of the following substitutions compared to its naturally occurring counterpart: T36X, M37X, S40X, E53X, S75X, T79X, W100X, T101X, S102X, A103X, R105X, Y121X, V123X, Q124X, Y125X, E126X, Y167X, V168X, F169X, L196X, N221X, S248X, E251X, K286X, K290X, D298X, and G339X, where X is any amino acid, an amino acid that results in a conservative substitution, or a cysteine, and where each position is counted in gtUBP5 with the signal peptide replaced with a methionine (SEQ ID NO: 16 or 216). In some embodiments, the modified gtUBP5 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T36C, M37C, S40C, S40I, E53Q, S75C, T79C, W100C, T101C, S102C, S102A, A103C, R105C, Y121A, Y121C, V123A, V123T, V123N, V123Q, V123H, Q124C, Q124A, Q124S, Q124N, Q124A, Q124D, Q124E, Q124H, Q124T, Q124Y, Q124M, Q124L, Y125C, E126C, E126Q, E126D, E126A, Y167A, Y167C, V168C, F169A, F169C, L196C, N221A, N221Q, N221S, N221D, N221E, N221H, N221T, N221L, N221C, S248A, S248N, S248Q, S248H, S248C, E251A, K286N, K290M, D298S, and G339E.

In various embodiments, a biosensor comprises a modified ctUBP6. In non-limiting examples, the modified ctUBP6 may comprise one or more, or any combination of the following substitutions compared to its naturally occurring counterpart: T31X, M32X, S35X, E48X, S70X, T74X, C94X, W95X, T96X, S97X, A98X, R100X, Y116X, V118X, Q119X, Y120X, E121X, Y162X, V163X, F164X, L191X, N216X, C240X, S243X, E246X, K281X, K285X, D293X, and E334X, where X is any amino acid, an amino acid that results in a conservative substitution, or a cysteine, and where each position is counted in ctUBP6 with the signal peptide replaced with a methionine (SEQ ID NO: 17 or 217). In some embodiments, the modified ctUBP6 comprises 1, 2, 3, 4, 5, 6, 7, 8, 9, 10, 11, 12, 13, 14, 15, 16, 17, 18, 19, 20, 21, 22, 23, 24, 25, 26, 27, 28, or 29 of the following substitutions: T31C, M32C, S35C, S35I, E48Q, S70C, T74C, C94A, W95C, T96C, S97C, S97A, A98C, R100C, Y116A, Y116C, V118A, V118T, V118N, V118Q, V118H, Q119C, Q119A, Q119S, Q119N, Q119A, Q119D, Q119E, Q119H, Q119T, Q119Y, Q119M, Q119L, Y120C, E121C, E121Q, E121D, E121A, Y162A, Y162C, V163C, F164A, F164C, L191C, N216A, N216Q, N216S, N216D, N216E, N216H, N216T, N216L, N216C, C240A, S243A, S243N, S243Q, S243H, S243C, E246A, K281N, K285M, D293S, and E334G.

In various embodiments, a biosensor comprises a modified csUBP7. In non-limiting examples, the modified csUBP7 may comprise one or more, or any combination of the following substitutions compared to its naturally occurring counterpart: T26X, M27X, S30X, E43X, S65X, T69X, W90X, T91X, S92X, A93X, R95X, Y111X, V113X, Q114X, Y115X, E116X, Y157X, V158X, F159X, L186X, N211X, S238X, E241X, K276X, K280X, D288X, and E329X, where X is any amino acid, an amino acid that results in a conservative substitution, or a cysteine, and where each position is counted in csUBP7 with the signal peptide replaced with a methionine (SEQ ID NO: 18 or 218). The sequence for csUBP7 (SEQ ID NO: 18 or 218) comprises a C89A mutation. In some embodiments, the modified csUBP7 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T26C, M27C, S30C, S30I, E43Q, S65C, T69C, W90C, T91C, S92C, S92A, A93C, R95C, Y111A, Y111C, V113A, V113T, V113N, V113Q, V113H, Q114C, Q114A, Q114S, Q114N, Q114A, Q114D, Q114E, Q114H, Q114T, Q114Y, Q114M, Q114L, Y115C, E116C, E116Q, E116D, E116A, Y157A, Y157C, V158C, F159A, F159C, L186C, N211A, N211Q, N211S, N211D, N211E, N211H, N211T, N211L, N211C, S238A, S238N, S238Q, S238H, S238C, E241A, K276N, K280M, D288S, and E329G.

In various embodiments, a biosensor comprises a modified taUBP8. In non-limiting examples, the modified taUBP8 may comprise one or more, or any combination of the following substitutions compared to its naturally occurring counterpart: T47X, M48X, S51X, E64X, S86X, T90X, W111X, T112X, S113X, A114X, R116X, Y132X, V134X, Q135X, F136X, E137X, Y178X, V179X, F180X, L207X, N232X, S259X, E262X, A297X, K301X, T309X, and F351X, where X is any amino acid, an amino acid that results in a conservative substitution, or a cysteine, and where each position is counted in taUBP8 with the signal peptide replaced with a methionine (SEQ ID NO: 19 or 219). The sequence for taUBP8 (SEQ ID NO: 19 or 219) comprises C141A and C402A mutations. In some embodiments, the modified taUBP8 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T47C, M48C, S51C, S51I, E64Q, S86C, T90C, W111C, T112C, S113C, S113A, A114C, R116C, Y132A, Y132C, V134A, V134T, V134N, V134Q, V134H, Q135C, Q135A, Q135S, Q135N, Q135A, Q135D, Q135E, Q135H, Q135T, Q135Y, Q135M, Q135L, F136C, E137C, E137Q, E137D, E137A, Y178A, Y178C, V179C, F180A, F180C, L207C, N232A, N232Q, N232S, N232D, N232E, N232H, N232T, N232L, N232C, S259A, S259N, S259Q, S259H, S259C, E262A, A297N, A297K, K301M, T309S, T309D, F351E, and F351G.

In various embodiments, a biosensor comprises a modified gkUBP10. In non-limiting examples, the modified gkUBP10 may comprise one or more, or any combination of the following substitutions compared to its naturally occurring counterpart: T143X, M144X, S147X, E160X, S182X, T186X, W207X, T208X, S209X, A210X, R212X, Y228X, V230X, Q231X, Y232X, E233X, Y274X, V275X, F276X, L303X, N328X, S355X, E358X, K393X, K397X, D405X, and E446X, where X is any amino acid, an amino acid that results in a conservative substitution, or a cysteine, and where each position is counted in gkUBP10 with the signal peptide replaced with a methionine (SEQ ID NO: 20). In some embodiments, the modified gkUBP10 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T143C, M144C, S147C, S147I, E160Q, S182C, T186C, W207C, T208C, S209C, S209A, A210C, R212C, Y228A, Y228C, V230A, V230T, V230N, V230Q, V230H, Q231C, Q231A, Q231S, Q231N, Q231A, Q231D, Q231E, Q231H, Q231T, Q231Y, Q231M, Q231L, Y232C, E233C, E233Q, E233D, E233A, Y274A, Y274C, V275C, F276A, F276C, L303C, N328A, N328Q, N328S, N328D, N328E, N328H, N328T, N328L, N328C, S355A, S355N, S355Q, S355H, S355C, E358A, K393N, K397M, D405S, and E446G.

In various embodiments, a biosensor comprises a modified psUBP11. In non-limiting examples, the modified psUBP11 may comprise one or more, or any combination of the following substitutions compared to its naturally occurring counterpart: T140X, M141X, S144X, E157X, S179X, T183X, W204X, T205X, S206X, A207X, R209X, Y225X, V227X, Q228X, Y229X, E230X, Y244X, V245X, F246X, L300X, N325X, S352X, E355X, K390X, K394X, A402X, and E443X, where X is any amino acid, an amino acid that results in a conservative substitution, or a cysteine, and where each position is counted in psUBP11 with the signal peptide replaced with a methionine (SEQ ID NO: 21). In some embodiments, the modified psUBP11 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T140C, M141C, S144C, S144I, E157Q, S179C, T183C, W204C, T205C, S206C, S206A, A207C, R209C, Y225A, Y225C, V227A, V227T, V227N, V227Q, V227H, Q228C, Q228A, Q228S, Q228N, Q228A, Q228D, Q228E, Q228H, Q228T, Q228Y, Q228M, Q228L, Y229C, E230C, E230Q, E230D, E230A, Y244A, Y244C, V245C, F246A, F246C, L300C, N325A, N325Q, N325S, N325D, N325E, N325H, N325T, N325L, N325C, S352A, S352N, S352Q, S352H, S352C, E355A, K390N, K394M, A402S, A402D, and E443G.

In various embodiments, a biosensor comprises a modified teUBP12. In non-limiting examples, the modified teUBP12 may comprise one or more, or any combination of the following substitutions compared to its naturally occurring counterpart: T122X, M123X, S126X, E139X, S161X, T165X, W186X, T187X, S188X, A189X, R191X, Y207X, V209X, Q210X, Y211X, E212X, Y253X, V254X, F255X, L282X, N309X, S336X, E339X, A374X, K378X, N386X, and E428X, where X is any amino acid, an amino acid that results in a conservative substitution, or a cysteine, and where each position is counted in teUBP12 with the signal peptide replaced with a methionine (SEQ ID NO: 22). The sequence for teUBP12 (SEQ ID NO: 22 or 222) comprises C185A, C216A, and C481A mutations. In some embodiments, the modified teUBP12 comprises 1, 2, 3, 4, 5, 6, 7, 8, 9, 10, 11, 12, 13, 14, 15, 16, 17, 18, 19, 20, 21, 22, 23, 24, 25, 26, or 27 of the following substitutions: T122C, M123C, S126C, S126I, E139Q, S161C, T165C, W186C, T187C, S188C, S188A, A189C, R191C, Y207A, Y207C, V209A, V209T, V209N, V209Q, V209H, Q210C, Q210A, Q210S, Q210N, Q210A, Q210D, Q210E, Q210H, Q210T, Q210Y, Q210M, Q210L, Y211C, E212C, E212Q, E212D, E212A, Y253A, Y253C, V254C, F255A, F255C, L282C, N309A, N309Q, N309S, N309D, N309E, N309H, N309T, N309L, N309C, S336A, S336N, S336Q, S336H, S336C, E339N, A374N, A374K, K378M, N386S, N386D, and E428G.

In various embodiments, the disassociation constant of the mutant urea-binding polypeptide differs by at least about 1 μM, 5 μM, 10 μM, 20 μM, 25 μM, 30 μM, 35 μM, 40 μM, 45 μM, 50 μM, 75 μM, 100 μM, 200 μM, 300 μM, 400 μM, 500 μM, 600 μM, 700 μM, 800 μM, 900 μM, 1 mM, 2 mM, 3 mM, 4 mM, 5 mM, 6 mM, 7 mM, 8 mM, 9 mM, 10 mM, 20 mM, 30 mM, 40 mM, 50 mM, 60 mM, 70 mM, 80 mM, 90 mM, 100 mM, 110 mM, 120 mM, 130 mM, 140 mM, 150 mM, 160 mM, 170 mM, 180 mM, 190 mM, or 200 mM (increase or decrease) compared to its naturally occurring counterpart.

The biosensors and ligand-binding proteins provided herein are robust and useful at a wide range of physical conditions, e.g., pressure, temperature, salinity, osmolality, and pH conditions. For example, biosensors and ligand-binding proteins provided herein may survive substantial periods of time after being dried or exposed to high temperatures. In some embodiments, the biosensor maintains at least about 75%, 80%, 85%, 90%, 95%, 96%, 97%, 98%, 99%, 99.5%, 99.9%, or more of its signal transduction activity after exposure to a temperature of about 40, 45, 50, 55, 60, 65, 70, 75, 80, 85, 90, 95, 100, 105, 110, 115, 120, or 125, or 40-125° C. for about 1, 2, 3, 4, 5, 6, 15, 30, 60, 120, 180, 240, or 360 minutes. In certain embodiments, the biosensor maintains at least about 75%, 80%, 85%, 90%, 95%, 96%, 97%, 98%, 99%, 99.5%, 99.9%, or more of its signal transduction activity after 1, 2, 3, 4, or 5 freeze-thaw cycles in an aqueous solution. In various embodiments, the biosensor maintains at least about 75%, 80%, 85%, 90%, 95%, 96%, 97%, 98%, 99%, 99.5%, 99.9%, or more of its signal transduction activity after storage at a temperature of between 20-37° C. for about 1, 2, 3, 4, 5, 6, 7, 8, 9, 10, 11, 12, 18, 24, or 1-24 months in dry form. In some embodiments, the optimal functional temperature of the biosensor is between 41 and 122° C., between 20 and 40° C., or less than about 10° C. (e.g., between −20 and +10° C.). Devices, compositions, and biosensors provided herein may be stored, e.g., with or without protection from exposure to light. In some embodiments, the devices, compositions, and biosensors are stored in the dark, e.g., with protection from light.

Reporter Group Attachment

Aspects of the present subject matter provide a biosensor that comprises a one or more reporter groups attached to a ligand-binding protein, wherein binding of a ligand to a ligand-binding domain of the ligand-binding protein causes a change in signaling by the reporter group. In various embodiments, the reporter group is attached to an endosteric site, an allosteric site, or a peristeric site of the ligand-binding protein. In embodiments, the reporter group is covalently or noncovalently attached to the ligand-binding protein.

As used herein, "signaling" refers to the emission of energy (which may be referred to as a "signal") by one or more reporter groups. In various implementations, the signal comprises electromagnetic radiation such as a light. In some embodiments, the signal is detected as a complete emission spectrum (or spectrums) or a portion (or portions) thereof. For example, a signal may comprise emitted light at a particular wavelength or wavelengths, or range(s) of wavelengths. In some embodiments, a change in signaling comprises a spectral change (e.g., a spectral shift and/or change in intensity). In some embodiments, a change in signaling comprises a dichromatic shift or a monochromatic fluorescence intensity change.

For convenience and depending on context, a reporter group may be referred to by a name of an unattached form of the reporter group regardless of whether the reporter group is attached to a ligand-binding protein. For example, a compound known as "Compound A" when in an unconjugated form may be referred to herein as "Compound A" when in a form that is attached to a ligand-binding protein. In a specific example, the term "Acrylodan" is used to refer to unreacted/unconjugated Acrylodan, as well as Acrylodan that is conjugated to a ligand-binding protein.

In certain embodiments, a biosensor comprises a reporter group that is conjugated to a ligand-binding protein, and the reporter group is conjugated to an amino acid of the protein that is at least about 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, or 100 angstroms (Å) from the ligand when the ligand is bound to the protein. In embodiments, the reporter group is conjugated to an amino acid of the protein that is about 0.1 Å to about 100 Å, about 0.1 Å to about 5 Å, about 5 Å to about 10 Å, about 10 Å to about 20 Å, about 20 Å to about 50 Å, about 50 Å to about 75 Å, or about 75 Å to about 100 Å from the ligand when the ligand is bound to the protein. In some embodiments, the reporter group is conjugated to an amino acid of the protein that is within an α-helix or a β-strand. In some embodiments, the reporter group is conjugated to an amino acid that is not within an α-helix or a β-strand, but is within about 10, 9, 8, 7, 6, 5, 4, 3, 2, or 1 amino acids of an amino acid of the protein's amino acid sequence that is within an α-helix or a β-strand. In some embodiments, the reporter group is conjugated to an amino acid that is in an inter-domain hinge amino acid region between two domains of a protein. In some embodiments, the reporter group is conjugated to an amino acid that is between (i) α-helix and a β-strand; (ii) two α-helixes; or (iii) two β-strands of a protein. In some embodiments, the reporter group is conjugated to an amino acid (e.g., a cysteine such as a cysteine added by substitution compared to a naturally corresponding polypeptide) between positions 1-25, 25-50, 50-75, 75-100, 100-125, 125-150, 150-175, 175-200, 200-225, 225-250, 250-275, 275-350, 275-300, 275-325, 300-325, 300-350, 300-400, or 350-400 (inclusive) of a polypeptide (e.g., not including N-terminal fusion proteins compared to the polypeptide's naturally occurring counterpart).

Periplasmic binding proteins are characterized by two lobes connected by a hinge region; ligand bind at a location at the interface between the two domains. Such proteins or engineered versions thereof (as described herein) can adopt two different conformations: a ligand-free open form and a ligand-bound closed form, which interconvert through a relatively large bending motion around the hinge (FIG. 1A; Dwyer et al., 2004, Current Opinion in Structural Biology 12:495-504).

The remarkable adaptability of this superfamily of ligand-binding proteins is likely to have arisen from positioning the location of binding of the ligand at the interface between the lobes and from the large ligand-mediated conformational change. In this arrangement, ligands are placed within an environment that resembles a protein interior, but the residues forming the contact points or contact sites with the ligand are positioned at the surface of the lobes.

Direct signaling relationships between proteins and reporter groups are readily designed by replacing a residue known to form a ligand contact with a cysteine to which the fluorophore is attached ("endosteric" attachment site). Other, indirect signaling relationships can be established in two ways. The first relies on visual inspection of the ligand complex structure, and identifying residues that are located in the vicinity of the binding site, but do not interact directly with the ligand, and that are likely to be involved in conformational changes. Typically, such "peristeric" sites are located adjacent to the residues that form direct contacts with the bound ligand. In the case of the bPBPs, such residues are located at the perimeter of the inter-domain cleft that forms the ligand binding site location. The environment of these peristeric sites changes significantly upon formation of the closed state. These are examples of positions which are proximal to the ligand-binding pocket/domain. The second, most general, approach identifies sites in the protein structure that are located anywhere in the protein, including locations at some distance away from the ligand-binding site (i.e., distal to the ligand-binding pocket/domain), and undergo a local conformational change in concert with ligand binding. If the structures of both the open and closed states are known, then such "allosteric" sites can be identified using a computational method that analyzes the conformational changes that accompany ligand binding (Marvin et al., Proc. Natl. Acad. Sci. USA 94:4366-4371, 1997). Alternatively, once allosteric sites have been identified in one bPBP, modeling and structural homology arguments can be invoked to identify such sites in other bPBPs in which only one state has been characterized (Marvin & Hellinga, J. Am. Chem. Soc. 120:7-11, 1998). This generalized conformational analysis also may identify peristeric and endosteric sites, which were identified and classified by visual inspection.

In non-limiting implementations, the reporter group is attached to the ligand-binding protein via a biotin-avidin interaction. The reporter group may be, e.g., conjugated to biotin and the ligand-binding protein is conjugated to avidin. In an example, the avidin is bound to four biotin molecules wherein each biotin molecule is individually conjugated to a reporter group. Alternatively, the reporter group is conjugated to avidin and the ligand-binding protein is conjugated to biotin. For example, the avidin is bound to four biotin molecules, wherein each biotin molecule is individually conjugated to a ligand-binding protein.

As used herein, "conjugated" means covalently attached. One compound may be directly conjugated to another compound, or indirectly conjugated, e.g., via a linker.

In some embodiments, the reporter group is directly attached to the ligand-binding protein. In various embodiments, the reporter group is attached to an amino acid of the ligand-binding protein that is at least about 2, 4, 6, 8, 10, 11, 12, 13, 14, 15, 16, 17, 18, 19, 20, 25, 30, 35, 40, 45, 50, 55, 60, 65, 70, 75, 80, 85, 90, 95, or 100 angstroms (Å) from the ligand when the ligand is bound to the ligand-binding protein. In certain embodiments, the reporter group is conjugated to an amino acid having a position within positions 1-25, 25-50, 50-75, 75-100, 100-125, 125-150, 150-175, 175-200, 200-225, 225-250, 250-275, or 275-300 of the ligand-binding protein, wherein position 1 is the N-terminal amino acid of the ligand-binding protein. In non-limiting examples, the reporter group is conjugated to an amino acid of the ligand-binding protein that is (a) within an α-helix or a β-strand of the ligand-binding protein; (b) not within an α-helix; (c) not within a β-strand; (d) within about 5 or 10 amino acids of an amino acid that is within an α-helix or β-strand; (e) within a stretch of consecutive amino acids that links two domains of the ligand-binding protein; (f) within a stretch of consecutive amino acids that links an α-helix and a β-strand; (g) within a stretch of consecutive amino acids that links two α-helices; or (h) within a stretch of consecutive amino acids that links two β-strands. In some embodiments, the reporter group is directly attached to the N-terminus or the C-terminus of the ligand-binding protein.

The reporter group may be conjugated to the ligand-binding protein a variety of linkers or bonds, including (but not limited to) a disulfide bond, an ester bond, a thioester bond, an amide bond, or a bond that has been formed by a click reaction. In some embodiments, the click reaction is a reaction between (a) an azide and an alkyne; (b) an azide and an alkyne in the presence of Cu(I); (c) an azide and a strained cyclooctyne; (d) an azide and a dibenzylcyclooctyne, a difluorooctyne, or a biarylazacyclooctynone; (e) a diaryl-strained-cyclooctyne and a 1,3-nitrone; (f) an azide, a tetrazine, or a tetrazole and a strained alkene; (g) an azide, a tetrazine, or a tretrazole and a oxanorbomadiene, a cyclooctene, or a trans-cycloalkene; (h) a tetrazole and an alkene; or (i) a tetrazole with an amino or styryl group that is activated by ultraviolet light and an alkene. These exemplary click chemistry reactions have high specificity, efficient kinetics, and occur in vivo under physiological conditions. See, e.g., Baskin et al., 2007, *Proc. Natl. Acad. Sci. USA*, 104:16793; Oneto et al., 2014, *Acta biomaterilia*;

Neves et al., 2013, *Bioconjugate chemistry,* 24:934; Koo et al., 2012, *Angewandte Chemie,* 51:11836; Rossin et al., 2010, *Angewandte Chemie,* 49:3375, and U.S. Patent Application Publication No. 20160220686, published Aug. 4, 2016, the entire content of each of which is incorporated herein by reference. For a review of a wide variety of click chemistry reactions and their methodologies, see e.g., Nwe K and Brechbiel M W, 2009, *Cancer Biotherapy and Radiopharmaceuticals,* 24(3): 289-302; Kolb H C et al., 2001, *Angew. Chem. Int. Ed.,* 40: 2004-2021. The entire contents of each of the foregoing references are incorporated herein by reference.

As used herein, the term "linker" refers to a molecule or sequence (such as an amino acid sequence), that attaches, as in a bridge, one molecule or sequence to another molecule or sequence. "Linked" means attached or bound by covalent bonds, or non-covalent bonds, or other bonds, such as van der Waals forces. In some embodiments, a linker comprises a chemical structure that has resulted from a reaction used to attach one molecule to another.

In various implementations of the present subject matter, the reporter group is conjugated to a cysteine of the ligand-binding protein. The cysteine may be present in the amino acid sequence of a natural counterpart or version of the ligand-binding protein or added to the ligand-binding protein by a substitution mutation in a coding sequence or by altering the sequence synthetically using known chemical means. In some embodiments, the cysteine is at the N-terminus or the C-terminus of the ligand-binding protein. In some embodiments, the cysteine is no more than about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids from the N-terminus or the C-terminus of the ligand-binding protein. In some embodiments, the cysteine is at least about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids from the N-terminus or the C-terminus of the ligand-binding protein.

Non-limiting examples relate to the conjugation of a reporter group to a primary amine of the ligand-binding protein. In certain embodiments, the primary amine is present in a lysine of the ligand-binding protein. The lysine may be present in the amino acid sequence of a natural counterpart or version of the ligand-binding protein or added to the ligand-binding protein by a substitution mutation in a coding sequence or by altering the sequence synthetically using known chemical means. In some embodiments, the lysine is at the N-terminus or the C-terminus of the ligand-binding protein. In some embodiments, the lysine is no more than about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids from the N-terminus or the C-terminus of the ligand-binding protein. In some embodiments, the lysine is at least about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 5-15, 5-20, 5-25, 5-100, 10-15, 10-20, 10-25, 10-50, 10-100, 25-50, 25-75, or 25-100 amino acids from the N-terminus or the C-terminus of the ligand-binding protein.

Aspects of the present subject matter provide a biosensor in which the reporter group is attached to the ligand-binding protein via a linker. In some embodiments, the linker comprises an organic compound that is less than about 30, 20, 15, or 10 Å long. Non-limiting examples of linkers include O, S, NH, PH, and alkyl linkers.

"Alkyl," as used herein, refers to the radical of saturated or unsaturated aliphatic groups, including straight-chain alkyl, alkenyl, or alkynyl groups, branched-chain alkyl, alkenyl, or alkynyl groups, cycloalkyl, cycloalkenyl, or cycloalkynyl (alicyclic) groups, alkyl substituted cycloalkyl, cycloalkenyl, or cycloalkynyl groups, and cycloalkyl substituted alkyl, alkenyl, or alkynyl groups. Unless otherwise indicated, a straight chain or branched chain alkyl has 30 or fewer carbon atoms in its backbone (e.g., $C_1$-$C_{30}$ for straight chain, $C_3$-$C_{30}$ for branched chain), more preferably 20 or fewer carbon atoms, more preferably 12 or fewer carbon atoms, and most preferably 8 or fewer carbon atoms. Likewise, preferred cycloalkyls have from 3-10 carbon atoms in their ring structure, and more preferably have 5, 6 or 7 carbons in the ring structure. The ranges provided above are inclusive of all values between the minimum value and the maximum value. The term "alkyl" includes both "unsubstituted alkyls" and "substituted alkyls," the latter of which refers to alkyl moieties having one or more substituents replacing a hydrogen on one or more carbons of the hydrocarbon backbone. Such substituents include, but are not limited to, halogen, hydroxyl, carbonyl (such as a carboxyl, alkoxycarbonyl, formyl, or an acyl), thiocarbonyl (such as a thioester, a thioacetate, or a thioformate), alkoxyl, phosphoryl, phosphate, phosphonate, a phosphinate, amino, amido, amidine, imine, cyano, nitro, azido, sulfhydryl, alkylthio, sulfate, sulfonate, sulfamoyl, sulfonamido, sulfonyl, heterocyclyl, aralkyl, or an aromatic or heteroaromatic moiety. Unless the number of carbons is otherwise specified, "lower alkyl" as used herein means an alkyl group, as defined above, but having from one to ten carbons, more preferably from one to six carbon atoms in its backbone structure. Likewise, "lower alkenyl" and "lower alkynyl" have similar chain lengths. Preferred alkyl groups are lower alkyls. The alkyl groups may also contain one or more heteroatoms within the carbon backbone. Preferably the heteroatoms incorporated into the carbon backbone are oxygen, nitrogen, sulfur, and combinations thereof. In certain embodiments, the alkyl group contains between one and four heteroatoms.

In some embodiments, the linker comprises a bond formed by a chemical reaction involving a reactive group such as a maleimide group. Alternatively or in addition, the linker comprises a stretch of amino acids. In a non-limiting example, the linker comprises a polyglycine linker. In embodiments, the polyglycine linker comprises 2, 3, 4, 5, or more glycines. Optionally, the polyglycine linker further comprises a serine.

In various implementations, the reporter group is attached to a linker via a covalent bond and the linker is attached to a ligand-binding protein via a covalent bond. In embodiments, the covalent bond between the linker and the reporter group and/or the covalent bond between the linker and the ligand-binding protein is a disulfide bond, an ester bond, a thioester bond, an amide bond, a carbamate bond, or a bond that has been formed by a click reaction. Non-limiting examples of click reactions include reactions between an azide and an alkyne; an azide and an alkyne in the presence of Cu(I); an azide and a strained cyclooctyne; an azide and a dibenzylcyclooctyne, a difluorooctyne, or a biarylazacyclooctynone; a diaryl-strained-cyclooctyne and a 1,3-nitrone; an azide, a tetrazine, or a tetrazole and a strained alkene; an azide, a tetrazine, or a tretrazole and a oxanorbornadiene, a cyclooctene, or a trans-cycloalkene; a tetrazole and an alkene; or a tetrazole with an amino or styryl group that is activated by ultraviolet light and an alkene.

Reporter Groups

Various types of reporter groups may be used in embodiments of the present subject matter. For example, the reporter group may comprise a fluorophore that produces a fluorescent signal. Biosensors comprising a fluorophore may be referred to herein as fluorescently responsive sensors (FRSs).

Preferably, the binding of ligand to an FRS results in a change in ratiometric ΔR in the signal from a reporter group. A ratiometric signal ($R_{1,2}$) is defined as the quotient of two intensities, $I_{\lambda 1}$ and $I_{\lambda 2}$, measured at two independent wavelengths, $\lambda_1$ and $\lambda_2$ and may be calculated according to the following equation:

$$R_{1,2}=I_{\lambda 1}/I_{\lambda 2}$$

In some embodiments, intensities are, e.g., integrated, filtered, assessed, detected, or evaluated over a range of wavelengths. In some embodiments, intensities are integrated over a range of wavelengths in a recorded emission spectrum. In some embodiments, a range of wavelengths is selected using a filter. In some embodiments, $\lambda_1$ is the intensity over a 1 nm to 60 nm interval centered between 400 and 1000 nm, and $\lambda_2$ is the intensity over a 1 nm to 60 nm interval centered between 400 nm and 1000 nm. In some embodiments, intensities are integrated, filtered, assessed, detected, or evaluated over a 1 nm, 2 nm, 10 nm, 15 nm, 20 nm, 25 nm, 30 nm, 35 nm, 40 nm, 45 nm, 50 nm, 55 nm, 60 nm, 75 nm, 100 nm, 10-40 nm, 10-50 nm, 20-50 nm, or 10-100 nm regions, centered between 400-1000 nm, e.g. between 420 nm and 520 nm for $\lambda_1$, and 400-1000 nm, e.g. between 500 nm to 600 nm for $\lambda_2$. In some embodiments, intensities are recorded through a bandpass filter. A non-limiting example of a bandpass filter is a 10 nm, 15-nm, 20 nm, 25 nm, 30 nm, 35 nm, 40 nm, 45 nm, 50 nm, 75 nm, 100 nm, 10-40 nm, 10-50 nm, 20-50 nm, or 10-100 nm bandpass filter, centered between 400-1000 nm, e.g. at 452 nm for $\lambda_1$ and at 400-1000 nm, e.g. at 528 nm ($\lambda_2$).

Aspects of the present subject matter provide FRSs whose emission spectra change (e.g., the shape of the emission spectra change) in response to ligand binding. In various embodiments, the ratio of intensities at two chosen wavelengths of an FRS's emission spectrum changes upon ligand binding. In some embodiments, the emission spectral shape and/or intensity of the fluorophore changes when the position of atoms within the fluorophore changes with respect to each other (e.g., due to the rotation of bound atoms with respect to each other or a change in the angle of a bond). In non-limiting examples, the emission spectral shape and/or intensity of the fluorophore changes when (i) one portion of the fluorophore rotates around a bond axis compared to another portion of the fluorophore and/or (ii) when the angle of a bond between two atoms of the fluorophore changes. In a non-limiting example, the fluorophore is a prodan-derived fluorophore (e.g., Acrylodan or Badan) and binding of ligand alters the orientation of a dimethylamino group, a naphthalene ring, and/or a carbonyl with respect to the ligand-binding protein and/or each other. In another non-limiting example, the fluorophore is Alexa532. In a non-limiting example, the degree of polarization of a dipole on the fluorophore changes in response to ligand binding. In various embodiments, the emission spectral shape and/or intensity of the fluorophore changes when an atom electrostatically interacts with the fluorophore. For example, the emission spectral shape and/or intensity of the fluorophore changes when the source of a positive or negative charge changes its distance with respect to the fluorophore within about 1, 2, 3, 4, 5, or 10 Å of the fluorophore. In some embodiments, the fluorophore exhibits hypsochromicity or bathochromicity upon ligand binding to the ligand-binding domain of the ligand-binding protein. In certain embodiments, the fluorophore has an emission spectrum comprising radiation with a wavelength (e.g., a peak emission wavelength) of about 400 nm, 410 nm, 420 nm, 430 nm, 440 nm, 450 nm, 460 nm, 470 nm, 480 nm, 490 nm, 500 nm, 510 nm, 520 nm, 530 nm, 540 nm, 550 nm, 560 nm, 570 nm, 580 nm, 590 nm, 600 nm, 610 nm, 620 nm, 630 nm, 640 nm, 650 nm, 660 nm, 670 nm, 680 nm, 690 nm, 700 nm, 710 nm, 720 nm, 730 nm, 740 nm, 750 nm, 760 nm, 770 nm, 780 nm, 790 nm, 800 nm, 850 nm, 900 nm, 950 nm, or 1000 nm, or about 400 nm to about 450 nm, about 450 nm to about 500 nm, about 500 nm to about 550 nm, about 550 nm to about 600 nm, about 600 nm to about 650 nm, about 650 to about 700 nm, about 700 nm to about 750 nm, about 750 nm to about 800 nm, or about 800 nm to about 1000 nm.

In some embodiments, the signal comprises the emission intensity of the fluorophore recorded at a single wavelength or range of wavelengths. The change in signal may be a shift in the single wavelength or range of wavelengths. In some embodiments, the shift in the wavelength is at least about 1 nm, at least about 2 nm, at least about 3 nm, at least about 4 nm, at least about 5 nm, at least about 6 nm, at least about 7 nm, at least about 8 nm, at least about 9 nm, at least about 10 nm, at least about 11 nm, at least about 12 nm, at least about 13 nm, at least about 14 nm, at least about 15 nm, at least about 16 nm, at least about 17 nm, at least about 18 nm, at least about 19 nm, at least about 20 nm, at least about 25 nm, at least about 30 nm, at least about 35 nm, at least about 40 nm, at least about 45 nm, at least about 50 nm, at least about 55 nm, at least about 60 nm, at least about 65 nm, at least about 70 nm, at least about 75 nm, at least about 80 nm, at least about 85 nm, at least about 90 nm, at least about 95 nm, at least about 100 nm, at least about 105 nm, at least about 110 nm, at least about 115 nm, at least about 120 nm, at least about 125 nm, or at least about 130 nm. In some embodiments, the shift in the wavelength is about 1 nm to about 20 nm, about 2 nm to about 20 nm, about 3 nm to about 20 nm, about 4 nm to about 20 nm, about 5 nm to about 20 nm, about 1 nm to about 19 nm, about 1 nm to about 18 nm, about 1 nm to about 17 nm, 1 nm to about 16 nm, about 1 nm to about 15 nm, about 1 nm to about 14 nm, about 1 nm to about 13 nm, about 1 nm to about 12 nm, about 1 nm to about 11 nm, or about 1 nm to about 10 nm. In some embodiments, the shift in the wavelength is about 1 nm to about 20 nm. In some embodiments, the shift in the wavelength is about 1 nm to about 130 nm.

In certain embodiments, the signal comprises the ratio or quotient of the emission intensities recorded at two distinct wavelengths or ranges of wavelengths, i.e., a ratiometric signal. For example, as shown in FIG. 1A-D, ligand binding may be determined by measuring the ratio of blue to green emission intensities. The change in signal may be decreased emission intensity at one wavelength, and no change in emission intensity at the other wavelength. The change in signal may be increased emission intensity at one wavelength, and no change in emission intensity at the other wavelength. The change in signal may be increased emission intensity at one wavelength, and increased emission intensity at the other wavelength. The change in signal may be decreased emission intensity at one wavelength, and decreased emission intensity at the other wavelength. The change in signal may be increased emission intensity at one wavelength, and decreased emission intensity at the other wavelength. In some embodiments, the change in ratio of the emission intensities recorded at two distinct wavelengths or ranges of wavelengths may be at least about 1.1-fold, at least about 1.2-fold, at least about 1.4-fold, at least about 1.6-fold, at least about 1.8-fold, at least about 2.0-fold, at least about 2.5-fold, at least about 3-fold, at least about 3.5-fold, at least about 4-fold, at least about 4.5-fold, at least about 5-fold, at least about 5.5-fold, at least about 6-fold, at least about 6.5-fold, at least about 7-fold, at least about 7.5-fold, at least about 8-fold, at least about 8.5-fold, at least about 9-fold, at least about 9.5-fold, at least about 10-fold, at least about 12-fold, at least about 14-fold, at least about 16-fold, at least about 18-fold, at least about 20-fold, at least about 25-fold, at least about 30-fold, at least about 35-fold, at least about 40-fold, at least about 45-fold, at least about 50-fold, at least about 55-fold, at least about 60-fold, at least about 65-fold, at least about 70-fold, at least about 75-fold, at least about 80-fold, at least about 85-fold, at least about 90-fold, at least about 95-fold, or at least about 100-fold. In some embodiments, the change in ratio of the emission intensities recorded at two distinct wavelengths or ranges of wavelengths may be a decrease of at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, or 99%, or of 5-25%, 25-50%, 25-75%, 50-75%, 50-90%, or 75-99% or the reciprocal thereof.

The change in signal may be a change in the ratio of the two distinct wavelengths or ranges of wavelengths. The change in signal may be a shift in the two distinct wavelengths or ranges of wavelengths. In some embodiments, one wavelength shifts. In some embodiments, both wavelengths shift. In some embodiments, the shift in the wavelength is at least about 1 nm, at least about 2 nm, at least about 3 nm, at least about 4 nm, at least about 5 nm, at least about 6 nm, at least about 7 nm, at least about 8 nm, at least about 9 nm, at least about 10 nm, at least about 11 nm, at least about 12 nm, at least about 13 nm, at least about 14 nm, at least about 15 nm, at least about 16 nm, at least about 17 nm, at least about 18 nm, at least about 19 nm, at least about 20 nm, at least about 25 nm, at least about 30 nm, at least about 35 nm, at least about 40 nm, at least about 45 nm, at least about 50 nm, at least about 55 nm, at least about 60 nm, at least about 65 nm, at least about 70 nm, at least about 75 nm, at least about 80 nm, at least about 85 nm, at least about 90 nm, at least about 95 nm, at least about 100 nm, at least about 105 nm, at least about 110 nm, at least about 115 nm, at least about 120 nm, at least about 125 nm, or at least about 130 nm. In some embodiments, the shift in the wavelength is about 1 nm to about 20 nm, about 2 nm to about 20 nm, about 3 nm to about 20 nm, about 4 nm to about 20 nm, about 5 nm to about 20 nm, about 1 nm to about 19 nm, about 1 nm to about 18 nm, about 1 nm to about 17 nm, 1 nm to about 16 nm, about 1 nm to about 15 nm, about 1 nm to about 14 nm, about 1 nm to about 13 nm, about 1 nm to about 12 nm, about 1 nm to about 11 nm, or about 1 nm to about 10 nm. In some embodiments, the shift in the wavelength is about 1 nm to about 20 nm. In some embodiments, the shift in the wavelength is about 1 nm to about 130 nm.

A fluorophore may comprise, e.g., a fluorescent protein or an organic compound having a molecular weight less than about 2000 Daltons (Da). Non-limiting examples of commercially available fluorophores include such as 5-iodoacetamidofluorescein (5-IAF) or 6-iodoacetamidofluorescein (6-IAF), rhodamine, Oregon Green, eosin, Texas Red, indocarbocyanine, oxacarbocyanine, thiacarbocyanine, merocyanine, Badan, Acrylodan, IAEDANS, comprising 3-cyano-7-hydroxycoumarin, 7-hydroxycoumarin-3-carboxylic acid, 6,8-difluoro-7-hydroxy-4-methylcoumarin, or 7-amino-4-methylcoumarin, pyridyloxazole, nitrobenzoxadiazole, benzoxadiazole, DRAQ5, DRAQ7, or CyTRAK Orange, cascade blue, Nile red, Nile blue, cresyl violet, oxazine 170, proflavin, acridine orange, acridine yellow, auramine, crystal violet, malachite green, porphin, phthalocyanine, bilirubin, pyrene, N,N'-dimethyl-N-(iodoacetyl)-N'-(7-nitrobenz-2-ox-a-1,3-diazol-4-yl)ethylenediamide (NBD), N-((2-(iodoacetoxy)ethyl)-N-methy-1)amino-7-nitrobenz-2-oxa-1,3-diazole (NBDE), JPW4039, JPW4042, JPW4045, Pacific Blue, CPM, N,N'-Dimethyl-N-(Iodoacetyl)-N'-(7-Nitrobenz-2-Oxa-1,3-Diazol-4-yl)Ethylenediamine (IANBD), 7-diethylamino-3-(4'-maleimidylphenyl)-4-methylcoumarin (CPM), BODIPY 499, BODIPY 507/545, BODIPY 499/508, Alexa 432, Alexa488, Alexa532, Alexa546, Cy5, or 1-(2-maleimidylethyl)-4-(5-(4-methoxyphenyl)oxazol-2-yl)pyridinium methanesulfonate (PyMPO maleimide) (PyMPO). In various embodiments, the reporter group was thiol-reactive prior to being conjugated to a polypeptide disclosed herein. In embodiments, the reporter group is linked to a polypeptide disclosed herein via a disulfide bond. Additional non-limiting examples of commercially available fluorophores include fluorescent proteins such as Blue Fluorescent Protein (BFP), TagBFP, mTagBFP2, Azurite, Enhanced Blue Florescent Protein 2 (EBFP2), mKalama1, Sirius, Sapphire, T-Sapphire, Cyan Fluorescent Protein (CFP); Enhanced Cyan Fluorescent Protein (ECFP), Cerulean, SCFP3A, mTurquoise, mTurquoise2, monomeric Midoriishi-Cyan, TagCFP, mTFP1, AmCyan1, Green Fluorescent Protein (GFP), Enhanced Green Fluorescent Protein (EGFP), Emerald, Superfolder GFP, AcGFP1, ZsGreen1, Monomeric Azami Green, TagGFP2, mUKG, mWasabi, Clover, mNeonGreen, Yellow Fluorescent Protein (YFP), Enhanced Yellow Fluorescent Protein (EYFP), Citrine, Venus, Super Yellow Fluorescent Protein 2 (SYFP2), TagYFP, ZsYellow1, mBanana, Orange Fluorescent Protein (OFP), Monomeric Kusabira-Orange (mKO), mKOκ, mKO2, mOrange, mOrange2, Red Fluorescent Protein (RFP), DsRed-Express, DsRed-Express2, DsRed2, AsRed2, mRaspberry, mCheny, mStrawberry, mTangerine, tdTomato, TagRFP, TagRFP-T, mApple, mRuby, mRuby2, mPlum, HcRed-Tandem, mKate2, mNeptune, HcRed1, E2-Crimson, NirFP, TagRFP657, IFP1.4, or iRFP.

In some embodiments, the fluorophore comprises xanthene, a xanthene derivative, cyanine, a cyanine derivative, squaraine, a squaraine derivative, naphthalene, a naphthalene derivative, coumarin, a coumarin derivative, oxadiazole, an oxadiazole derivative, anthracene, an anthracene derivative, a boradiazaindacine (BODIPY) family fluorophore, pyrene, a pyrene derivative, acridine, an acridine derivative, arylmethine, an arylmethine derivative, tetrapyrrole, or a tetrapyrrole derivative. For example, the fluorophore may comprise a xanthene derivative comprising fluorescein or a fluorescein derivative, rhodamine, Oregon Green, eosin, or Texas Red. Non-limiting examples of fluorescein derivatives include 5-fluorescein, 6-carboxyfluorescein, 3'6-carboxyfluorescein, 5(6)-carboxyfluorescein, 6-hexachlorofluorescein, 6-tetrachlorofluorescein, or isothiocyanate. In some embodiments, the fluorophore comprises a cyanine derivative comprising indocarbocyanine, oxacarbocyanine, thiacarbocyanine, or merocyanine. In certain embodiments, the fluorophore comprises a squaraine derivative comprising a ring-substituted squaraine. In various embodiments, the fluorophore comprises a naphthalene derivative comprising a dansyl or prodan naphthalene derivative. In a non-limiting example, the fluorophore comprises prodan or a derivative thereof. In certain embodiments, the fluorophore comprises Badan, Acrylodan, or N-(Iodoacetaminoethyl)-1-naphthylamine-5-sulfonic acid (IAEDANS). In some embodiments, the fluorophore comprises a coumarin derivative such as 3-cyano-7-hydroxycoumarin, 7-hydroxycoumarin-3-carboxylic acid, 6,8-difluoro-7-hydroxy-4-methylcoumarin (DiFMU), or 7-amino-4-methylcoumarin. In various embodiments, the fluorophore comprises an oxadiazole derivative such as pyridyloxazole, nitrobenzoxadiazole, or benzoxadiazole. In certain embodiments, the fluorophore comprises an anthracene derivative comprising an anthraquinone such as DRAQ5, DRAQ7, or CyTRAK Orange. In various embodiments, the fluorophore comprises a pyrene derivative comprising cascade blue. In non-limiting examples the fluorophore comprises an oxazine derivative such as Nile red, Nile blue, cresyl violet, or oxazine 170. In some embodiments, the fluorophore comprises an acridine derivative such as proflavin, acridine orange, or acridine yellow. In certain embodiments, the fluorophore comprises an arylmethine derivative such as auramine, crystal violet, or malachite green. In various embodiments, the fluorophore comprises a tetrapyrrole derivative comprising porphin, phthalocyanine, or bilirubin.

Aspects of the present subject matter relate to the use of fluorophores that may readily be attached to a ligand-binding protein disclosed herein, e.g., at a cysteine residue. For example, a fluorophore may comprise a sulfhydryl group prior to attachment to a ligand-binding protein that is reacted with a moiety of the ligand-binding protein to attach the fluorophore to the ligand-binding protein. In some embodiments, the fluorophore comprised a thiol group prior to attachment to the ligand-binding protein. For example, the fluorophore was thiol reactive prior to attachment to the ligand-binding protein. Non-limiting examples of fluorophores that may readily be attached to ligand-binding proteins using thiol reactions include fluorescein, pyrene, NBD, NBDE, Acrylodan (6-acryloyl 1-2-dimethylaminonaphthalene), Badan (6-bromo-acetyl-2-dimethylamino-naphthalene), JPW4039, JPW4042, or JPW4045.

In certain embodiments, the fluorophore comprises a derivative of a Prodan-based fluorophore such as Acrylodan or Badan. The excitation and emission properties of the Prodan-based fluorophores Acrylodan and Badan can be altered by manipulating the fluorescent ring system, while preserving the dimethylamino donor group, and the twistable carbonyl acceptor (Klymchenko, 2013, *Progress in Molecular Biology and Translational Science*, 35-58). Replacement of the two-ring naphthalene with a three-ring anthracene (Lu, 2006, *J. Org. Chem.*, 71, 9651-9657), fluorene (Kucherak, 2010, *J. Phys. Chem. Lett.*, 1, 616-620), pyrene (Niko, 2013, *Chem. Eur. J.*, 19, 9760-9765), or styrene (Benedetti, 2012, *J. Am. Chem. Soc.*, 134, 12418-12421) cores significantly red-shift the excitation and emission properties, and in the case of the latter two, improve brightness through improvements in their excitation peak extinction coefficients. The entire content of each of the references cited above (as well as all other references referred to herein including the contents of nucleic acid and amino acid sequence accession number references) are incorporated herein by reference. Non-limiting examples of prodan analogues include 2-cyano-6-dihexylaminoanthracene and 2-propionyl-6-dihexylaminoanthracene, as well as fluorophores comprising the following structures:

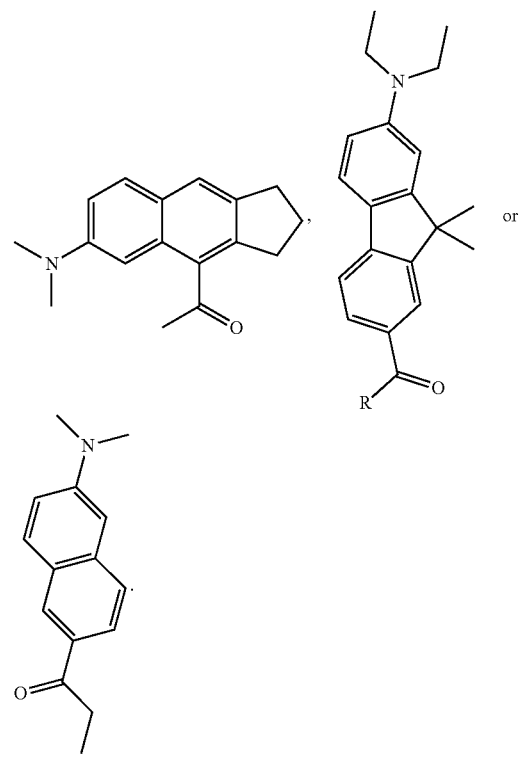

In some embodiments, the fluorophore comprises Alexa532.

In some embodiments, the fluorophore comprises a fluorescent protein. Fluorescent proteins that emit blue, cyan, green, yellow, orange, red, far-red, or near infrared radiation when contacted with excitation radiation are known in the art and commercially available as proteins and via the expression of vectors that encode the fluorescent protein. Non-limiting examples of fluorescent proteins include Blue Fluorescent Protein (BFP), TagBFP, mTagBFP2, Azurite, Enhanced Blue Florescent Protein 2 (EBFP2), mKalama1, Sirius, Sapphire, T-Sapphire, Cyan Fluorescent Protein (CFP); Enhanced Cyan Fluorescent Protein (ECFP), Cerulean, SCFP3A, mTurquoise, mTurquoise2, monomeric Midoriishi-Cyan, TagCFP, mTFP1, AmCyan1, Green Fluorescent Protein (GFP), Enhanced Green Fluorescent Protein (EGFP), Emerald, Superfolder GFP, AcGFP1, ZsGreen1, Monomeric Azami Green, TagGFP2, mUKG, mWasabi, Clover, mNeonGreen, Yellow Fluorescent Protein (YFP), Enhanced Yellow Fluorescent Protein (EYFP), Citrine, Venus, Super Yellow Fluorescent Protein 2 (SYFP2), TagYFP, ZsYellow1, mBanana, Orange Fluorescent Protein (OFP), Monomeric Kusabira-Orange (mKO), mKOκ, mKO2, mOrange, mOrange2, Red Fluorescent Protein (RFP), DsRed-Express, DsRed-Express2, DsRed2, AsRed2, mRaspberry, mCherry, mStrawberry, mTangerine, tdTomato, TagRFP, TagRFP-T, mApple, mRuby, mRuby2, mPlum, HcRed-Tandem, mKate2, mNeptune, HcRed1, E2-Crimson, NirFP, TagRFP657, IFP1.4, or iRFP.

In some embodiments, the fluorophore comprises a quantum dot (Medintz et al., 2005, *Nat Mater.*, 4(6):435-46.) (Sapsford, Berti and Medintz, 2006, *Angew Chem Int Ed Engl*, 45, 4562-89; Resch-Genger et al., 2008, *Nat Methods*, 5, 763-75). In some embodiments the emission properties of the conjugated protein are enhanced by immobilization on or near metallic nanoparticles (Zeng et al., 2014, *Chem Soc Rev*, 43, 3426-52; Shen et al., 2015, *Nanoscale*, 7, 20132-41).

In various embodiments, the peak emission wavelength and/or the emission intensity of the biosensor change when the ligand binds to the ligand-binding protein. In some embodiments, the biosensor exhibits a dichromatic signaling change when the ligand binds to the ligand-binding protein. In various embodiments, the peak emission wavelength of the biosensor shifts by at least about 5, 10, 15, 20, 30, 40, 50, or by about 5-50 nm when the biosensor binds to ligand. In certain embodiments, the emission intensity of the biosensor increases by at least about 5%, 10%, 20%, 30%, 40%, 50%, 60%, 70%, 80%, 90%, 100%, 150%, 200%, or 300% when the biosensor binds to ligand. In various embodiments, the signal produced by the reporter group persists for at least 1 nanoseconds (ns), 5 ns, 10 ns, 25 ns, 50 ns, 75 ns, 100 ns, 200 ns, 300 ns, 400 ns, 500 ns, 600 ns, 700 ns, 800 ns, 900 ns, 0.001 milliseconds (ms), 0.01 ms, 0.1 ms, 1 ms, 5 ms, 10 ms, 20 ms, 25 ms, 50 ms, 100 ms, or 500 ms when the ligand binds to the ligand-binding protein.

Ratiometric Sensing with Fluorescence Energy Transfer

The present subject matter provides methods for converting monochromatic responses into dichromatic responses that enable ratiometric sensing. If the fluorescence emission spectrum changes shape in response to analyte binding such that the ratio of emission intensities at two appropriately chosen wavelengths reports on analyte concentration (dichromatic response), then ratiometric measurements can be used to monitor analyte concentrations. In embodiments, these methods are based on establishing non-geometrically modulated Förster resonance energy transfer (ngmFRET) between a fluorophore (a directly responsive partner), and a second fluorophore that neither interacts directly with the ligand, nor is sensitive to ligand-mediated changes in its environment (an indirectly responsive partner). Biosensors that undergo ngmFRET (or altered ngmFRET) upon ligand binding are also provided herein, as well as compositions and devices comprising such biosensors.

Methods, compounds, and compositions provided herein overcome challenges regarding the design of biosensors that produce a ratiometric signal. For example, a biosensor that exhibits a monochromatic response (which does not produce a ratiometric signal) to ligand binding may be converted into a biosensor that produces a dichromatic/ratiometric signal. Moreover, the number of fluorophores that may be utilized in ratiometric biosensors is dramatically increased by the present subject matter. For example, fluorophores that typically do not show a dichromatic response to ligand binding (such as fluorescein and derivatives thereof) may be used together with an additional reporter group (such as another fluorophore) to produce a ratiometric signal. Also included are methods, compounds, and compositions relating to biosensors with multiple reporter groups that have improved ratiometric signals compared to other ratiometric biosensors (e.g., ratiometric biosensors having a single reporter group).

Traditional/conventional geometrically-modulated Fluorescence Resonance Energy Transfer (tgmFRET) is a physical phenomenon that was first described over 50 years ago. In tgmFRET, the transfer of excited state energy from a donor fluorophore to an acceptor fluorophore (i.e. energy transfer) is modulated by a ligand-binding event through changes in the distance and/or angle between the donor and acceptor fluorophores. tgmFRET is manifested by opposing changes in the fluorescence emission intensities of the donor and acceptor fluorophores, respectively, in response to ligand binding. For instance, a decrease in distance results in a decrease of the donor fluorescence emission intensity and an increase in the acceptor fluorescence intensity, as energy is transferred from the former to the latter. A ligand-mediated increase in the distance between the partners has the opposite effect (the fluorescence emission intensity of the donor increases, whereas that of the acceptor decreases). In tgmFRET, ligand-mediated modulation of fluorescence intensity arises from global changes in the entire system, and can occur only if both partners are present.

By contrast, in ngmFRET ligand-mediated modulation of fluorescence intensity arises from changes that are localized to the photophysics of the directly responsive fluorophore. Unlike tgmFRET, ligand-mediated changes in fluorescence therefore occur also if only the directly responsive partner is present in isolation by itself. Although the entire ngmFRET system comprising two partners is not required for evincing ligand-mediated changes in fluorescence emission intensity, the response of such a system is qualitatively changed or quantitatively enhanced over the responses of the isolated directly responsive partner (e.g. converting a monochromatic into a dichromatic response, thereby enabling ratiometry). Furthermore, unlike tgmFRET, the pattern of fluorescence intensity changes manifested by ligand binding in ngmFRET systems are not limited to opposing changes only. Instead, in ngmFRET almost all combinations of emission intensity changes are possible: opposing changes in the two partners, both partners increase, both decrease, one partner remains unchanged whereas the other increases or decreases. The majority of these responses evince changes that are unequal in magnitude and/or direction (i.e. increase, decrease), and accordingly are manifested as ligand-mediated changes in the ratio of the two fluorescence emission intensities. This versatility of ngmFRET system response patterns has great utility in the field of fluorescent biosensors.

The ligand-mediated alteration of the photophysics of the directly responsive partner includes changes to its spectral properties such as the shape of the excitation or emission spectra, and the ratio of radiative to non-radiative emission rates. The fluorescence emission intensity of the indirectly responsive partner in isolation does not change in response to ligand binding; its intensity changes only in the presence of a directly responsive partner in the complete ngmFRET system. In the field fluorescence spectroscopy, the term "quenching" has often been used loosely to refer to a decrease fluorescence emission intensity. However, as used herein, the term "quenching" strictly means a "change in the ratio of radiative to non-radiative emission rates" of a fluorophore.

Aspects of the present subject matter provide biosensors in which ngmFRET occurs between two or more reporter groups (e.g., a donor fluorophore and an acceptor fluorophore) of the biosensor. For example, ngmFRET may change (e.g., increase or decrease) when ligand is bound to the biosensor and a donor fluorophore is contacted with radiation within its excitation wavelength. Effects from tgmFRET and ngmFRET may occur together and be combined into an overall ligand-mediated change in fluorescence emission intensity. In preferred embodiments, less than half or none of the change in overall ligand-mediated change in fluorescence emission intensity is due to tgmFRET. In embodiments, most of the overall ligand-mediated change in fluorescence emission intensity change is not due to a change in the distance between the donor and acceptor fluorophore or as a result of a change in the orientation between the donor and acceptor fluorophore. In non-limiting examples, less than about 25%, 20%, 15%, 10%, 5%, 4%, 3%, 2%, 1%, or 0.5% of the change in overall ligand-mediated change in fluorescence emission intensity is due to tgmFRET. In various embodiments, at least about 70%, 75%, 80%, 85%, 90%, 95%, 96%, 97%, 98%, 99%, 99.5%, 99.9%, or 99.99% of the ligand-mediated change in fluorescence emission intensity is due to ngmFRET. For example, the change in overall ligand-mediated change in fluorescence emission intensity comprises a spectral change (e.g., in the excitation or emission spectrum) and/or a change in the ratio of the radiative to non-radiative decay rates of one of the fluorophores (by itself and regardless of the presence of any other fluorophore/partner) upon ligand binding.

In some embodiments, ligand binding mediates spectral shifts in the absorption or emission spectrum of the directly responsive partner. In certain embodiments such changes are due at least in part to a switch between different excited states in the ligand-free and ligand-bound biosensor. The two excited states are associated with different transition dipoles. This class of changes is termed "dipole switching" herein.

In embodiments, the reporter groups include a directly responsive partner (which may be a donor fluorophore or an acceptor fluorophore) and an indirectly responsive partner (which may be a donor fluorophore or an acceptor fluorophore). Depending on context, a "directly responsive" partner is a fluorophore that responds to (i) ligand-induced protein conformational changes upon ligand binding to a ligand-binding protein; or (ii) ligand binding to the directly responsive partner itself. In some embodiments, the directly responsive partner comprises a fluorophore (i.e., it is a directly responsive fluorophore). In various embodiments, the directly responsive fluorophore exhibits a monochromatic or dichromatic spectral change, and/or a change in the ratio of radiative to non-radiative emission rates, upon ligand binding. In certain embodiments relating to ligand binding to the directly responsive partner itself, the directly responsive partner may be a fluorophore such as a fluorescent protein or a small molecule fluorescent compound. An "indirectly responsive" partner is a fluorophore for which no change in emission spectra, excitation spectra, or change in the ratio of radiative to non-radiative emission rates is caused by ligand binding in the absence of a directly responsive partner. In some embodiments, the indirectly responsive partner comprises a fluorophore (i.e., it is an indirectly responsive fluorophore). When paired with a directly responsive partner with which the indirectly responsive partner is a ngmFRET donor or acceptor, the emission fluorescence intensity of the indirectly responsive partner changes due to a change in energy flow in the ngmFRET pathway upon ligand binding. See, e.g., FIG. 110.

ngmFRET Biosensors

Provided herein are methods, compositions, biosensors, and devices comprising multiple reporter groups, e.g. a directly responsive fluorophore and an indirectly responsive fluorophore, between which ngmFRET occurs.

Aspects include a method of detecting a urea in a sample, comprising contacting a biosensor with a urea. The biosensor comprises a urea-binding protein, a directly responsive fluorophore and an indirectly responsive fluorophore. The directly responsive and the indirectly responsive fluorophores are located at two distinct sites of the urea-binding-protein. In some embodiments, the directly responsive fluorophore is a donor fluorophore and the indirectly responsive fluorophore is an acceptor fluorophore. Alternatively, the directly responsive fluorophore is an acceptor fluorophore and the indirectly responsive fluorophore is a donor fluorophore. The method includes contacting the biosensor with radiation comprising a wavelength within the excitation spectrum of the donor fluorophore. When the biosensor is contacted with such radiation, a fluorescence property of the directly responsive fluorophore changes in response to urea binding. This change in fluorescent property is independent of the indirectly responsive fluorophore, and occurs regardless of whether the indirectly responsive fluorophore is absent or present. The fluorescence properties of the indirectly responsive fluorophore do not change in response to urea binding in the absence of the directly responsive fluorophore. When the biosensor is contacted with radiation comprising a wavelength within the excitation spectrum of the donor fluorophore, then (i) ngmFRET occurs between the directly responsive fluorophore and the indirectly responsive fluorophore; (ii) fluorescent light is emitted from the biosensor, and the light emitted from the biosensor comprises a combination of light emitted from the directly responsive fluorophore and light emitted from the indirectly responsive fluorophore; and (iii) the ratio of the fluorescence emission intensity emitted from the biosensor at each of two distinct wavelengths changes in response to urea binding. In various embodiments, the method further comprises measuring fluorescent light that is emitted from the directly responsive fluorophore and the indirectly responsive fluorophore, and calculating a ratiometric signal to detect the urea in the sample.

The ratiometric signal ($R_{1,2}$) comprises a quotient of two intensities, $I_{\lambda_1}$ and $I_{\lambda_2}$, measured at two independent wavelengths, $\lambda_1$ and $\lambda_2$ and is calculated according to the following equation:

$$R_{1,2} = I_{\lambda_1}/I_{\lambda_2}.$$

The two independent wavelengths $\lambda_1$ and $\lambda_2$ may be from a single fluorophore or from a combination of two or more fluorophores (e.g., a pair of fluorophores between which ngmFRET occurs). In some embodiments, $\lambda_1$ falls within the emission spectrum of a directly responsive fluorophore and $\lambda_2$ falls within the emission spectrum of an indirectly responsive fluorophore. In certain embodiments, $\lambda_1$ falls within the emission spectrum of an indirectly responsive fluorophore and $\lambda_2$ falls within the emission spectrum of a directly responsive fluorophore. In various embodiments, $\lambda_1$ falls within the emission spectrum of both a directly responsive fluorophore and an indirectly responsive fluorophore. In various embodiments, $\lambda_2$ falls within the emission spectrum of both a directly responsive fluorophore and an indirectly responsive fluorophore.

Aspects of the present subject matter provide FRSs whose emission spectra change (e.g., the shape of the emission spectra change) in response to urea binding. In various embodiments, the ratio of intensities at two chosen wavelengths of an FRS's emission spectrum changes upon urea binding.

In various embodiments, the emission spectra of two or more fluorophores contributes to $I_{\lambda_1}$ and/or $I_{\lambda_2}$. In some embodiments, the emission spectrum of a directly responsive fluorophore contributes to $I_{\lambda_1}$ and/or $I_{\lambda_2}$ and the emission spectrum of an indirectly responsive fluorophore contributes to $I_{\lambda_1}$ and/or $I_{\lambda_2}$. In certain embodiments, a directly responsive fluorophore contributes to $I_{\lambda_1}$ and the emission spectrum of an indirectly responsive fluorophore contributes to $I_{\lambda_2}$. In some embodiments, a directly responsive fluorophore contributes to $I_{\lambda_2}$ and the emission spectrum of an indirectly responsive fluorophore contributes to $I_{\lambda_1}$. In various embodiments, both the emission spectrum of a directly responsive fluorophore and the emission spectrum of an indirectly responsive fluorophore contributes to $I_{\lambda,1}$. In some embodiments, both the emission spectrum of a directly responsive fluorophore and the emission spectrum of an indirectly responsive fluorophore contributes to $I_{\lambda,2}$.

In some embodiments, the directly responsive fluorophore is Alexa532 and emission intensity is measured at a wavelength or range of wavelengths between about 400 nm and 1000 nm (e.g. including a wavelength of about 530, 531, 532, 534, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, or 570 nm), and wherein the indirectly responsive fluorophore is Acrylodan and emission intensity is measured at a wavelength or range of wavelengths between about 400 nm and 1000 nm (e.g. including 470, 471, 472, 473, 474, 475, 476, 477, 478, 479, 480, 481, 482, 483, 484, 45, 496, 487, 488, 489, 490, 491, 492, 493, 494, 495, 496, 497, 499, 500, 501, 502, 503, 504, 505, 506, 507, 508, 509, or 510 nm). In some embodiments, the directly responsive fluorophore is Acrylodan and emission intensity is measured at a wavelength or range of wavelengths between about 400 nm and 1000 nm (e.g., including a wavelength of about 480, 481, 482, 483, 484, 485, 486, 487, 488, 489, 490, 491, 492, 493, 494, 495, 496, 497, 498, 499, or 500 nm), and wherein the indirectly responsive fluorophore is Alexa532 and emission intensity is measured at a wavelength or range of wavelengths between about 400 nm and 1000 nm (e.g., including a wavelength of about 540, 541, 542, 543, 544, 545, 5546, 547, 548, 549, 550, 551, 552, 553, 554, 555, 556, 557, 558, 559, or 560 nm). In some embodiments, the directly responsive fluorophore is Badan and emission intensity is measured at a wavelength or range of wavelengths between about 400 nm and 1000 nm (e.g., including a wavelength of about 475, 476, 477, 478, 479, 480, 481, 482, 483, 484, 485, 486, 487, 488, 489, 490, 491, 492, 493, 494, or 495 nm), and wherein the indirectly responsive fluorophore is Alexa532 and emission intensity is measured at a wavelength or range of wavelengths between about 400 nm and 1000 nm (e.g., including a wavelength of about 545, 546, 547, 548, 549, 550, 51, 552, 553, 554, 555, 556, 557, 558, 559, 560, 561, 562, 563, 564, or 565 nm). In some embodiments, the directly responsive fluorophore is Acrylodan and emission intensity is measured at a wavelength or range of wavelengths between about 400 nm and 1000 nm (e.g., including a wavelength of about 500, 501, 502, 503, 504, 505, 506, 507, 508, 509, 510, 511, 512, 513, 514, 515, 516, 517, 518, 519, 520 nm), and wherein the indirectly responsive fluorophore is Alexa532 and emission intensity is measured at a wavelength or range of wavelengths between about 400 nm and 1000 nm (e.g., including a wavelength of about 540, 541, 542, 543, 544, 545, 5546, 547, 548, 549, 550, 551, 552, 553, 554, 555, 556, 557, 558, 559, or 560 nm). In some embodiments, the directly responsive fluorophore is Badan and emission intensity is measured at a wavelength or range of wavelengths between about 400 nm and 1000 nm (e.g., including a wavelength of about 545, 546, 547, 548, 549, 550, 51, 552, 553, 554, 555, 556, 557, 558, 559, 560, 561, 562, 563, 564, or 565 nm), and wherein the indirectly responsive fluorophore is Alexa532 and emission intensity is measured at a wavelength or range of wavelengths between about 400 nm and 1000 nm (e.g., including a wavelength of about 500, 501, 502, 503, 504, 505, 506, 507, 508, 509, 510, 511, 512, 513, 514, 515, 516, 517, 518, 519, 520 nm). In some embodiments, the directly responsive fluorophore is Badan and emission intensity is measured at a wavelength or range of wavelengths between about 400 nm and 1000 nm (e.g., including a wavelength of about 480, 481, 482, 483, 484, 485, 486, 487, 488, 489, 490, 491, 492, 493, 494, 495, 496, 497, 498, 499, or 500 nm), and wherein the indirectly responsive fluorophore is Alexa532 and emission intensity is measured at a wavelength or range of wavelengths between about 400 nm and 1000 nm (e.g., including a wavelength of about 540, 541, 542, 543, 544, 545, 5546, 547, 548, 549, 550, 551, 552, 553, 554, 555, 556, 557, 558, 559, or 560 nm). In some embodiments, the directly responsive fluorophore is Acrylodan and emission intensity is measured at a wavelength or range of wavelengths between about 400 nm and 1000 nm (e.g., including a wavelength of about 470, 471, 472, 473, 474, 475, 476, 477, 478, 479, 480, 481, 482, 483, 484, 485, 486, 489, or 490 nm), and wherein the indirectly responsive fluorophore is Alexa532 and emission intensity is measured at a wavelength or range of wavelengths between about 400 nm and 1000 nm (e.g., including a wavelength of about 540, 541, 542, 543, 544, 545, 5546, 547, 548, 549, 550, 551, 552, 553, 554, 555, 556, 557, 558, 559, or 560 nm). In some embodiments, the directly responsive fluorophore is Badan and emission intensity is measured at a wavelength or range of wavelengths between about 400 nm and 1000 nm (e.g., including a wavelength of about 475, 476, 477, 478, 479, 480, 481, 482, 483, 484, 485, 486, 487, 488, 489, 490, 491, 492, 493, 494, or 495 nm), and wherein the indirectly responsive fluorophore is Texas Red and emission intensity is measured at a wavelength or range of wavelengths between about 400 nm and 1000 nm (e.g., including a wavelength of about 600, 601, 602, 603, 604, 605, 606, 607, 608, 609, 610, 611, 612, 613, 614, 615, 616, 617, 618, 619, or 620 nm). In some embodiments, the directly responsive fluorophore is Oregon Green and emission intensity is measured at a wavelength or range of wavelengths between about 400 nm and 1000 nm (e.g., including a wavelength of about 515, 516, 517, 518, 519, 520, 521, 522, 523, 524, 525, 526, 527, 528, 529, 530, 531, 532, 533, 534, or 535 nm), and wherein the indirectly responsive fluorophore is Pacific Blue and emission intensity is measured at a wavelength or range of wavelengths between about 400 nm and 1000 nm (e.g., including a wavelength of about 445, 446, 447, 448, 449, 450, 451, 452, 453, 454, 455, 456, 457, 458, 459, 460, 461, 462, 463, 464, or 465 nm). In some embodiments, the directly responsive fluorophore is Alexa532 and emission intensity is measured at a wavelength or range of wavelengths between about 400 nm and 1000 nm (e.g., including a wavelength of about 550, 551, 552, 553, 554, 555, 56, 557, 558, 559, 560, 561, 562, 563, 564, 565, 566, 567, 568, 569, or 570 nm), and wherein the indirectly responsive fluorophore is Badan and emission intensity is measured at a wavelength or range of wavelengths between about 400 nm and 1000 nm (e.g., including a wavelength of about 475, 476, 477, 478, 479, 480, 481, 482, 483, 484, 485, 486, 487, 488, 489, 490, 491, 492, 493, 494, or 495 nm). In some embodiments, the directly responsive fluorophore is Alexa532 and emission intensity is measured at a wavelength or range of wavelengths between about 400 nm and 1000 nm (e.g., including a wavelength of about 550, 551, 552, 553, 554, 555, 56, 557, 558, 559, 560, 561, 562, 563, 564, 565, 566, 567, 568, 569, or 570 nm), and wherein the indirectly responsive fluorophore is Acrylodan and emission intensity is measured at a wavelength or range of wavelengths between about 400 nm and 1000 nm (e.g., including a wavelength of about 475, 476, 477, 478, 479, 480, 481, 482, 483, 484, 485, 486, 487, 488, 489, 490, 491, 492, 493, 494, or 495 nm).

Various embodiments, the urea-binding protein comprises a cysteine at the position of its amino acid sequence that aligns with position 26, 27, 30, 95, or 186 of csUBP7 (SEQ ID NO: 18 or 218) when the amino acid sequence of the urea-binding protein is aligned with the amino acid sequence of csUBP7 using the ClustalW alignment program, and wherein the Acrylodan or the Badan is covalently attached to the cysteine. In some embodiments, the Alexa532 or the Texas Red is attached to the N-terminus or the C-terminus of the urea-binding protein via a fluorophore attachment motif. In a non-limiting example, the urea-binding protein comprises amino acids in the sequence of SEQ ID NO: 98. Alternatively, the urea-binding protein comprises a cysteine at the position of its amino acid sequence that aligns with position 186 of csUBP7 (SEQ ID NO: 18 or 218) when the amino acid sequence of the urea-binding protein is aligned with the amino acid sequence of csUBP7 using the ClustalW alignment program, and wherein the Oregon Green or the Alexa532 is covalently attached to the cysteine. In some embodiments, the Pacific Blue, the Acrylodan, or the Badan is attached to the N-terminus or the C-terminus of the urea-binding protein via a fluorophore attachment motif.

In various embodiments, the change in the fluorescent property of the directly responsive fluorophore comprises (i) a bathochromic or hypsochromic shift in the emission or excitation spectrum thereof; and/or (ii) a change in the ratio of radiative to non-radiative emission rates thereof.

In embodiments, the directly responsive fluorophore comprises a donor fluorophore and the indirectly responsive fluorophore comprises an acceptor fluorophore. In some embodiments, the emission intensity of the donor fluorophore decreases and the emission intensity of the acceptor fluorophore increases upon urea binding to the urea-binding protein when the donor fluorophore is contacted with radiation within the excitation spectrum of the donor fluorophore. In some embodiments, the emission intensity of the donor fluorophore increases and the emission intensity of the acceptor fluorophore decreases upon urea binding to the urea-binding protein when the donor fluorophore is contacted with radiation within the excitation spectrum of the donor fluorophore. In some embodiments, the emission intensities of the donor fluorophore and the acceptor fluorophore both decrease upon urea binding to the urea-binding protein when the donor fluorophore is contacted with radiation within the excitation spectrum of the donor fluorophore. In some embodiments, the emission intensity of the donor fluorophore decreases and the emission intensity of the acceptor fluorophore increases, decreases, or remains about the same upon urea binding to the urea-binding protein when the donor fluorophore is contacted with radiation within the excitation spectrum of the donor fluorophore. In some embodiments, the emission intensity of the donor fluorophore increases, decreases, or remains about the same and the emission intensity of the acceptor fluorophore decreases upon urea binding to the urea-binding protein when the donor fluorophore is contacted with radiation within the excitation spectrum of the donor fluorophore. In some embodiments, the emission intensities of the donor fluorophore and the acceptor fluorophore both increase upon urea binding to the urea-binding protein when the donor fluorophore is contacted with radiation within the excitation spectrum of the donor fluorophore. In some embodiments, the emission intensity of the donor fluorophore increases, decreases, or remains about the same and the emission intensity of the acceptor fluorophore increases upon urea binding to the urea-binding protein when the donor fluorophore is contacted with radiation within the excitation spectrum of the donor fluorophore. In some embodiments, the emission intensity of the donor fluorophore increases and the emission intensity of the acceptor fluorophore increases, decreases, or remains about the same upon urea binding to the urea-binding protein when the donor fluorophore is contacted with radiation within the excitation spectrum of the donor fluorophore.

In embodiments the directly responsive fluorophore comprises an acceptor fluorophore and the indirectly responsive fluorophore comprises a donor fluorophore. In some embodiments, the emission intensity of the donor fluorophore decreases and the emission intensity of the acceptor fluorophore increases, decreases, or remains about the same upon urea binding to the urea-binding protein when the donor fluorophore is contacted with radiation within the excitation spectrum of the donor fluorophore. In some embodiments, the emission intensity of the donor fluorophore increases and the emission intensity of the acceptor fluorophore increases, decreases, or remains about the same upon urea binding to the urea-binding protein when the donor fluorophore is contacted with radiation within the excitation spectrum of the donor fluorophore. In some embodiments, the emission intensity of the donor fluorophore remains about the same and the emission intensity of the acceptor fluorophore decreases upon urea binding to the urea-binding protein when the donor fluorophore is contacted with radiation within the excitation spectrum of the donor fluorophore. In some embodiments, the emission intensity of the donor fluorophore decreases and the emission intensity of the acceptor fluorophore increases, decreases, or remains about the same upon urea binding to the urea-binding protein when the donor fluorophore is contacted with radiation within the excitation spectrum of the donor fluorophore. In some embodiments, the emission intensity of the donor fluorophore increases and the emission intensity of the acceptor fluorophore increases, decreases, or remains about the same upon urea binding to the urea-binding protein when the donor fluorophore is contacted with radiation within the excitation spectrum of the donor fluorophore. In some embodiments, the emission intensity of the donor fluorophore remains about the same and the emission intensity of the acceptor fluorophore increases upon urea binding to the urea-binding protein when the donor fluorophore is contacted with radiation within the excitation spectrum of the donor fluorophore. In some embodiments, the emission intensity of the donor fluorophore decreases and the emission intensity of the acceptor fluorophore increases upon urea binding to the urea-binding protein when the donor fluorophore is contacted with radiation within the excitation spectrum of the donor fluorophore. In some embodiments, the emission intensity of the donor fluorophore increases and the emission intensity of the acceptor fluorophore remains about the same, increases, or decreases upon urea binding to the urea-binding protein when the donor fluorophore is contacted with radiation within the excitation spectrum of the donor fluorophore.

In instances in which an emission intensity increases, the increase may be, e.g., between about 0.1% to 10%, 10% to 50%, or 50% to 100%, or at least about 0.1%, 0.5%, 1%, 2%, 3%, 4%, 5%, 10%, 15%, 20%, 25%, 50%, 75%, 100%, 2-fold, 3-fold, 4-fold, 5-fold, 6-fold, 7-fold, 8-fold, 9-fold, or 10-fold. In instances in which an emission intensity decreases, the decrease may be, e.g., a decrease of between about at least about 0.1% to 10%, 10% to 50%, or 50% to 00%, or at least about 0.1%, 0.5%, 1%, 2%, 3%, 4%, 5%, 10%, 15%, 20%, 25%, 30%, 35%, 40%, 45%, 50%, 55%, 60%, 65%, 70%, 75%, 80%, 85%, or 90%. In various embodiments in which both the emission intensity of the donor fluorophore and the acceptor fluorophore increases, then the increases are not equal. In certain embodiments in which both the emission intensity of the donor fluorophore and the acceptor fluorophore decreases, then the decreases are not equal.

In certain embodiments, the indirectly responsive fluorophore is attached to the urea-binding protein via a covalent bond. Various approaches for attaching reporter groups such as directly and indirectly responsive fluorophores to a polypeptide such as a urea-binding protein are described herein. In some embodiments, the covalent bond comprises a disulfide bond, a thioester bond, a thioether bond, an ester bond, an amide bond, or a bond that has been formed by a click reaction.

In some embodiments, the indirectly responsive fluorophore is attached to the urea-binding protein via a non-covalent bond. In certain embodiments, the indirectly responsive fluorophore is attached to a cysteine or a lysine of the urea-binding protein.

In various embodiments, the indirectly responsive fluorophore is attached to the N-terminus or the C-terminus of the protein. In some embodiments, the indirectly responsive fluorophore is attached to the N-terminus or the C-terminus of the protein via a fluorophore attachment motif.

In some embodiments, fluorophore attachment motif comprises a polypeptide. Various embodiments may be used to link a fluorophore with a urea-binding protein. In some embodiments, the polypeptide comprises a stretch of at least 50, 60, 70, 80, 90, or 100 amino acids. In a non-limiting example, the polypeptide comprises amino acids in the sequence of βZif (SEQ ID NO: 105). In another non-limiting example, the polypeptide comprises a stretch of at least 50, 60, 70, 80, 90, or 100 amino acids in a sequence that is at least about 85%, 90%, 95%, or 99% identical to the amino acid sequence of E. coli thioredoxin (ecTRX; SEQ ID NO: 229).

In some embodiments, the directly responsive fluorophore is attached to the urea-binding protein via a covalent bond. In various embodiments, the covalent bond comprises a disulfide bond, a thioester bond, a thioether bond, an ester bond, an amide bond, or a bond that has been formed by a click reaction. In directly responsive fluorophore is attached to a cysteine or a lysine of the protein.

In some embodiments, an overlap of the emission spectrum of the donor fluorophore and the excitation spectrum of the acceptor fluorophore increases upon urea binding. In certain embodiments, the directly responsive fluorophore comprises the donor fluorophore, and the increase results from a bathochromic shift in the emission spectrum of the donor fluorophore. Alternatively, the directly responsive fluorophore comprises the acceptor fluorophore, and the increase results from a hypsochromic shift in the excitation spectrum of the acceptor fluorophore.

In various embodiments, an overlap of the emission spectrum of the donor fluorophore and the excitation spectrum of the acceptor fluorophore decreases upon urea binding. In some embodiments, the directly responsive fluorophore comprises the donor fluorophore, and the decrease results from a hypsochromic shift in the emission spectrum of the donor fluorophore. In certain embodiments, the directly responsive fluorophore comprises the acceptor fluorophore, and the decrease results from a bathochromic shift in the excitation spectrum of the acceptor fluorophore.

In some embodiments, the directly responsive fluorophore has a monochromatic spectral change upon urea binding. Alternatively, the directly responsive fluorophore has a dichromatic spectral change upon urea binding.

In certain embodiments, the emission intensity of the donor fluorophore and/or the acceptor fluorophore increases in two phases as urea concentration increases.

In various embodiments, the ratio of radiative to non-radiative emission or intensity of the directly responsive fluorophore increases by at least about 0.1%, 0.5%, 1%, 2%, 3%, 4%, 5%, 10%, 15%, 20%, 25%, 50%, 75%, 100%, 2-fold, 3-fold, 4-fold, 5-fold, 6-fold, 7-fold, 8-fold, 9-fold, or 10-fold upon urea binding to the urea-binding protein. Alternatively, the ratio of radiative to non-radiative emission or intensity of the directly responsive fluorophore decreases by at least about 0.1%, 0.5%, 1%, 2%, 3%, 4%, 5%, 10%, 15%, 20%, 25%, 50%, 75%, 90%, 95%, or 99% upon urea binding to the urea-binding protein.

In embodiments, the directly responsive fluorophore and the indirectly responsive fluorophore are not a naphthalene derivative. In some embodiments, the directly responsive fluorophore and the indirectly responsive fluorophore are not Prodan, Acrylodan, or Badan. In certain embodiments, the directly responsive fluorophore is not a naphthalene derivative. In some embodiments, the directly responsive fluorophore is not Prodan, Acrylodan, or Badan.

In various embodiments, the directly responsive fluorophore comprises xanthene, a xanthene derivative, fluorescein, a fluorescein derivative, coumarin, a coumarin derivative, cyanine, a cyanine derivative, rhodamine, a rhodamine derivative, phenoxazine, a phenoxazine derivative, squaraine, a squaraine derivative, coumarin, a coumarin derivative, oxadiazole, an oxadiazole derivative, anthracene, an anthracene derivative, a boradiazaindacine (BODIPY) family fluorophore, pyrene, a pyrene derivative, acridine, an acridine derivative, arylmethine, an arylmethine derivative, tetrapyrrole, or a tetrapyrrole derivative. In some embodiments, the directly responsive fluorophore comprises fluorescein or a derivative thereof.

In some embodiments, the directly responsive fluorophore and/or the indirectly responsive fluorophore comprises a fluorescent protein. In various embodiments, the directly responsive fluorophore and/or the indirectly responsive fluorophore comprises an organic compound having a molecular weight less than about 2000 Da (e.g., 5-iodoacetamidofluorescein (5-IAF) or 6-iodoacetamidofluorescein (6-IAF), rhodamine, Oregon Green, eosin, Texas Red, indocarbocyanine, oxacarbocyanine, thiacarbocyanine, merocyanine, Badan, Acrylodan, IAEDANS, comprising 3-cyano-7-hydroxycoumarin, 7-hydroxycoumarin-3-carboxylic acid, 6,8-difluoro-7-hydroxy-4-methylcoumarin, or 7-amino-4-methylcoumarin, pyridyloxazole, nitrobenzoxadiazole, benzoxadiazole, DRAQ5, DRAQ7, or CyTRAK Orange, cascade blue, Nile red, Nile blue, cresyl violet, oxazine 170, proflavin, acridine orange, acridine yellow, auramine, crystal violet, malachite green, porphin, phthalocyanine, bilirubin, pyrene, N,N'-dimethyl-N-(iodoacetyl)-N'-(7-nitrobenz-2-ox-a-1,3-diazol-4-yl)ethylenediamide (NBD), N-((2-(iodoacetoxy)ethyl)-N-methy-1)amino-7-nitrobenz-2-oxa-1,3-diazole (NBDE), JPW4039, JPW4042, JPW4045, Pacific Blue, CPM, N,N'-Dimethyl-N-(Iodoacetyl)-N'-(7-Nitrobenz-2-Oxa-1,3-Diazol-4-yl)Ethylenediamine (IANBD), 7-diethylamino-3-(4'-maleimidylphenyl)-4-methylcoumarin (CPM), BODIPY 499, BODIPY 507/545, BODIPY 499/508, Alexa 432, Alexa488, Alexa532, Alexa546, Cy5, or 1-(2-maleimidylethyl)-4-(5-(4-methoxyphenyl)oxazol-2-yl)pyridinium methanesulfonate (PyMPO maleimide) (PyMPO)). Numerous combinations of directly responsive fluorophores and indirectly responsive fluorophores are possible. For example, in various non-limiting examples, (a) the donor fluorophore comprises Pacific Blue and the acceptor fluorophore comprises 5-IAF or 6-iodoacetamidofluorescein (6-IAF); (b) the donor fluorophore comprises Pacific Blue and the acceptor fluorophore comprises Oregon Green; (c) the donor fluorophore comprises IAEDANS and the acceptor fluorophore comprises 5-IAF or 6-IAF; (d) the donor fluorophore comprises acrylodan and the acceptor fluorophore comprises Alexa532; (e) the donor fluorophore comprises acrylodan and the acceptor fluorophore comprises 5-IAF or 6-IAF; (f) the donor fluorophore comprises acrylodan and the acceptor fluorophore comprises Pacific Blue or YFP; (g) the donor fluorophore comprises 5-IAF or 6-IAF and the acceptor fluorophore comprises Pacific Blue; (h) the donor fluorophore comprises badan and the acceptor fluorophore comprises 5-IAF or 6-IAF; or (i) the donor fluorophore comprises badan and the acceptor fluorophore comprises Alexa532.

Aspects also include a biosensor for a urea comprising a urea-binding protein, a directly responsive fluorophore and an indirectly responsive fluorophore, the directly responsive and the indirectly responsive fluorophores being located at two distinct sites of the urea-binding-protein, wherein (i) the directly responsive fluorophore is a donor fluorophore and the indirectly responsive fluorophore is an acceptor fluorophore; or (ii) the directly responsive fluorophore is an acceptor fluorophore and the indirectly responsive fluorophore is an donor fluorophore, and wherein if the acceptor fluorophore comprises ruthenium or osmium, then the acceptor fluorophore is not attached to the amino group of the N-terminus of the urea-binding protein.

Any of the urea-binding proteins disclosed herein, as well as others, may be included in the biosensors and methods that are provided.

Aspects of the present subject matter also provide a method for constructing a biosensor, comprising: (a) providing a urea-binding protein; (b) identifying at least one putative allosteric, endosteric, or peristeric site of the urea-binding based a structure of the urea-binding protein; (c) mutating the urea-binding protein to substitute an amino acid at the at least one putative allosteric, endosteric, or peristeric site of the second protein with a cysteine; (d) conjugating a donor fluorophore or an acceptor fluorophore to the cysteine to produce single labeled biosensor; (e) detecting whether there is a spectral shift or change in emission intensity of the single labeled biosensor upon urea binding when the donor fluorophore or the acceptor fluorophore is fully excited; and (f) if a spectral shift or change in emission intensity is detected in (e), attaching a donor fluorophore to the second protein if an acceptor fluorophore is attached to the cysteine, and attaching an acceptor fluorophore to the second protein if an acceptor fluorophore is attached to the cysteine.

In various embodiments, the urea-binding protein has been identified by (i) selecting a first protein having a known amino acid sequence (seed sequence), wherein the first protein is known to bind a urea; (ii) identifying a second protein having an amino acid sequence (hit sequence) with at least 15% sequence identity to the seed sequence; (iii) aligning the seed amino acid sequence and the hit sequence, and comparing the hit sequence with the seed sequence at positions of the seed sequence that correspond to at least 5 primary complementary surface (PCS) amino acids, wherein each of the at least 5 PCS amino acids has a hydrogen bond interaction or a van der Waals interaction with urea when urea is bound to the first protein; and (iv) identifying the second protein to be a urea-binding protein if the hit sequence comprises at least 5 amino acids that are consistent with the PCS.

In some embodiments, the spectral shift comprises a monochromatic fluorescence intensity change or a dichromatic spectral shift.

Also provided is a method of converting a biosensor that shows a monochromatic response upon urea binding into a biosensor with a dichromatic response upon urea binding, the method comprising (a) selecting a biosensor that exhibits a monochromatic response upon urea binding, wherein the biosensor comprises a urea-binding protein and a first reporter group; and (b) attaching a second reporter group to the biosensor, wherein the second reporter group has (i) an excitation spectrum that overlaps with the emission spectrum of the first reporter group; or (ii) an emission spectrum that overlaps with the excitation spectrum of the first reporter group.

Also provided is a method of increasing a dichromatic response of a biosensor to urea binding, the method comprising (a) selecting a biosensor that exhibits a dichromatic response upon urea binding, wherein the biosensor comprises a urea-binding protein and a first reporter group; and (b) attaching a second reporter group to the biosensor, wherein the second reporter group has (i) an excitation spectrum that overlaps with the emission spectrum of the first reporter group; or (ii) an emission spectrum that overlaps with the excitation spectrum of the first reporter group.

In some embodiments, the second reporter group is within about 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2, 4, 6, 8, 10, 11, 12, 13, 14, 15, 16, 17, 18, 19, 20, 25, 30, 35, 40, 45, 50, 55, 60, 65, 70, 75, 80, 85, 90, 95, 100, 125, 150, or 200 angstroms (Å) of the first reporter group regardless of whether ligand is bound to the biosensor. Suitable distances may be determined in part by the distance-dependence of the energy transfer between a given donor-acceptor pair (see, e.g, J. R. Lakowicz, 2006, Principles of Fluorescence Spectroscopy, Springer, incorporated herein by reference). In some embodiments, when the urea is bound to the biosensor, the average distance between the first reporter group and the second reporter group changes by less than about 5, 4, 3, 2, 1, 0.9, 0.8, 0.7, 0.6, 0.5, 0.4, 0.3, 0.2, 0.1, 0.05, or 0.01 angstroms (Å) compared to when urea is not bound to the urea-binding protein.

In various embodiments, if the acceptor fluorophore comprises palladium, platinum, ruthenium, or osmium, then the acceptor fluorophore is not attached to the amino group of the N-terminus of the ligand-binding protein. In some embodiments, the acceptor fluorophore does not comprise $[Ru(bpy)_3]^{2+}$, $[Ru(Ph_2phen)_3]^{2+}$, $[Ru(bpy)_2(dcbpy)]^{2+}$, or $[Ru(bpy)_2(phen-ITC)]^{2+}$, where bpy is 2,2'-bipyridine, phen is 1,10-phenanthroline, dcbpy is 4,4'-dicarboxy-2,2'-bipyridine, and ITC is isothiocyanate. In certain embodiments, the biosensor does not comprise an *E. coli* glutamine-binding protein with Acrylodan attached to 179C. In some embodiments, the biosensor does not comprise *E. coli* urea-binding protein with Acrylodan attached to 255C.

tgmFRET Biosensors

While ngmFRET is preferred to tgmFRET, tgmFRET may be used alternatively or in addition to ngmFRET in certain embodiments.

In various embodiments, the biosensor comprises multiple reporter groups, including a first reporter group and a second reporter group. For example, the first reporter group may comprise a donor fluorophore and the second reporter group may comprise an acceptor fluorophore. In certain embodiments, FRET is detectable by a change in the fluorescence of the acceptor fluorophore or by a decrease in of donor fluorophore fluorescence. In various embodiments, the donor fluorophore, and/or the acceptor fluorophore is fluorescent. In some embodiments, both the donor fluorophore and the acceptor fluorophore are fluorescent.

In various embodiments, the angle and/or distance between the donor fluorophore and the acceptor fluorophore changes upon urea binding. In some embodiments, neither the donor fluorophore nor the acceptor fluorophore is directly responsive to urea binding. In some embodiments the donor fluorophore and/or the acceptor fluorophore is attached to the N-terminus or the C-terminus of the urea-binding protein (e.g., directly or via a fluorophore attachment motif). In certain embodiments, the donor fluorophore and/or the acceptor fluorophore is attached to a fluorophore attachment motif. For example, the fluorophore attachment motif may be conjugated to the N-terminus or the C-terminus of the urea-binding protein.

In some embodiments, the donor fluorophore and/or the acceptor fluorophore comprises a fluorescent protein. In various embodiments, the donor fluorophore and/or the acceptor fluorophore comprises an organic compound having a molecular weight less than about 2000 Da (e.g., 5-iodoacetamidofluorescein (5-IAF) or 6-iodoacetamidofluorescein (6-IAF), rhodamine, Oregon Green, eosin, Texas Red, indocarbocyanine, oxacarbocyanine, thiacarbocyanine, merocyanine, Badan, Acrylodan, IAEDANS, comprising 3-cyano-7-hydroxycoumarin, 7-hydroxycoumarin-3-carboxylic acid, 6,8-difluoro-7-hydroxy-4-methylcoumarin, or 7-amino-4-methylcoumarin, pyridyloxazole, nitrobenzoxadiazole, benzoxadiazole, DRAQ5, DRAQ7, or CyTRAK Orange, cascade blue, Nile red, Nile blue, cresyl violet, oxazine 170, proflavin, acridine orange, acridine yellow, auramine, crystal violet, malachite green, porphin, phthalocyanine, bilirubin, pyrene, N,N'-dimethyl-N-(iodoacetyl)-N'-(7-nitrobenz-2-ox-a-1,3-diazol-4-yl)ethylenediamine (NBD), N-((2-(iodoacetoxy)ethyl)-N-methy-1)amino-7-nitrobenz-2-oxa-1,3-diazole (NBDE), Acrylodan, JPW4039, JPW4042, JPW4045, Oregon Green, Pacific Blue, CPM, N,N'-Dimethyl-N-(Iodoacetyl)-N'-(7-Nitrobenz-2-Oxa-1,3-Diazol-4-yl)Ethylenediamine (IANBD), 7-diethylamino-3-(4'-maleimidylphenyl)-4-methylcoumarin (CPM), BODIPY 499, BODIPY 507/545, BODIPY 499/508, Alexa 432, Alexa488, Alexa532, Alexa546, Cy5, or 1-(2-maleimidylethyl)-4-(5-(4-methoxyphenyl)oxazol-2-yl)pyridinium methanesulfonate (PyMPO maleimide) (PyMPO)). For example, the organic compound is a fluorophore. Numerous combinations of donor and acceptor fluorophores are possible.

Fluorophore Attachment Motifs

Aspects of the present subject matter include the use of one or more fluorophore attachment motifs to attach one or more reporter groups to a urea-binding protein. For example, a reporter group may be attached to a fluorophore attachment motif that is attached to the N-terminus or the C-terminus of the urea-binding protein.

In various implementations, the fluorophore attachment motif comprises a polypeptide. In some embodiments, the polypeptide comprises amino acids in the βZif amino acid sequence (SEQ ID NO: 105).

In some embodiments, the polypeptide comprises a stretch of at least 50, 60, 70, 80, 90, or 100 amino acids in a sequence that is at least about 85%, 90%, 95%, or 99% identical to the amino acid sequence of E. coli thioredoxin (ecTRX; SEQ ID NO: 229). In some embodiments, the polypeptide is a mutant of ecTRX comprising a D3X, K4X, K19X, D27X, K37X, K53X, K58X, K70X, R74X, K83X, K91X, K97X, or K101X mutation, or any combination thereof, wherein X is any amino acid, and wherein each ecTRX amino acid position is numbered as in SEQ ID NO: 229. In certain embodiments, the polypeptide is a mutant of ecTRX comprising a D3A, K4R, K4Q, K19R, K19Q, D27A, K37R, K53M, K53R, K58M, K70R, R74C, K83R, K91R, K97R, or K101R mutation, or any combination thereof, wherein each ecTRX amino acid position is numbered as in SEQ ID NO: 229.

In non-limiting examples, the polypeptide comprises amino acids in the sequence set forth as any one of SEQ ID NOS: 230-247.

In certain embodiments, the polypeptide comprises (a) at least 1, 2, or 3 thiol groups; (b) at least 1, 2, or 3 cysteines that each comprise a sulfhydryl group; (c) at least 1, 2, or 3 primary amine groups; and/or (d) at least 1, 2, or 3 lysines that each comprise a primary amine. In some embodiments there is no disulfide bond between cysteines within the amino acid sequence of the polypeptide.

In some embodiments, the polypeptide comprises a hexahistidine tag. In some embodiments, the hexahistidine tag is attached to another portion of the polypeptide via a GGS linker.

Exemplary Methods of Using Biosensors Provided Herein

Aspects of the present subject matter provide a method of assaying for a ligand in a sample. The method may include contacting the sample with a biosensor disclosed herein under conditions such that the ligand-binding protein of the biosensor binds to the ligand if ligand is present in the sample. The method also comprises detecting (i) whether a signal is produced by a reporter group of the biosensor; and/or (ii) the a signal produced by a reporter group of the biosensor. In a non-limiting example, a reporter group of the biosensor is fluorescent, and the method further comprises contacting the reporter group with electromagnetic radiation having a wavelength that comprises a wavelength within the band of excitation wavelengths of the reporter group.

In various embodiments, the method further comprises (i) comparing a signal produced by a reporter group of the biosensor when the biosensor is contacted with the sample with a signal produced by a control sample containing a known quantity of ligand (e.g., ligand at a concentration of about 0.5, 1, 2, 3, 4, 5, 6, 7, 8, 9, 10, 15, 20, 25, 30, 35, 40, 45, 50, 75, 100, 125, 150, 175, or 200 mM, or a series of control samples having concentrations within the range of about 0.5 mM to about 100 mM or 0.5 mM to about 200 mM); and (ii) detecting the presence or absence of ligand in the sample based on this comparison. In embodiments the control sample lacks urea (e.g., the concentration of urea is 0 mM). Alternatively or in addition, the method further comprises (i) comparing a signal produced by a reporter group of the biosensor when the biosensor is contacted with the sample with signals produced by a series of control samples containing known quantities of ligand; and (ii) determining the quantity of ligand in the sample based on this comparison. In some embodiments, the series of control samples comprises at least 2, 3, 4, 5, 6, 7, 8, 9, or 10 control samples, and wherein each control sample comprises a different quantity of ligand. Alternatively or in addition, the method further comprises determining the concentration of a ligand in a sample, wherein determining the concentration of the ligand in the sample comprises comparing the signal to a standard hyperbolic ligand binding curve to determine the concentration of the ligand in the test sample, wherein the standard hyperbolic ligand binding curve is prepared by measuring the signal produced by the reporter group of the biosensor when the biosensor is contacted with control samples containing known concentrations of ligand. In various embodiments, the method comprises (i) measuring a ratiometric change (ΔR) and/or an intensity change (ΔI) of a signal produced by the reporter group. In some embodiments, the method includes quantitating the level of ligand present in the sample.

In various embodiments, the ligand comprises urea and the ligand-binding protein comprises a urea-binding protein.

Aspects of the present subject matter also provide a method of assaying for multiple ligands in a sample, wherein the multiple ligands comprise a first ligand and a second ligand. Such a method may include contacting the sample with (i) a first biosensor a first ligand provided herein and (ii) a second biosensor for the second ligand, under conditions such that the ligand-binding protein of the first biosensor binds to the first ligand, if the first ligand is present in the sample, and detecting (i) a signal, e.g. magnitude of the signal, produced by a reporter group of the first biosensor, or (ii) whether a signal is produced by a reporter group of the first biosensor. In some embodiments, the second biosensor is also a biosensor provided herein, and the second biosensor is contacted with the second ligand under conditions such that the ligand-binding protein of the second biosensor binds to the second ligand it is present in the sample. The method may further comprise detecting (i) a signal, e.g. magnitude of the signal, produced by a reporter group of the second biosensor, or (ii) whether a signal is produced by a reporter group of the second biosensor.

In some embodiments, the signal produced by the reporter group of the first biosensor is different than the signal produced by the reporter group of the second biosensor. In a non-limiting example, the reporter group of the first biosensor and the reporter group of the second biosensor are each fluorescent, and the peak emission wavelength of the reporter group of the first biosensor is at least about 10, 25, 50, 75, or 100 nm greater or lower than the peak emission wavelength of the reporter group of the second biosensor.

Non-limiting examples of biosensors that may be used as the second biosensor include biosensors with ligand-binding proteins comprising a GGBP (e.g., an *E. coli* GGBP) or a derivative or mutant thereof; (ii) an *E. coli* arabinose binding protein (e.g., an *E. coli* arabinose binding protein) or a derivative or mutant thereof; (iii) a dipeptide binding protein (e.g., an *E. coli* dipeptide binding protein) or a derivative or mutant thereof; (iv) a histidine binding protein (e.g., an *E. coli*, histidine binding protein) or a derivative or mutant thereof; (v) a ribose binding protein (e.g., an *E. coli* ribose binding protein) or a derivative or mutant thereof; (vi) a sulfate binding protein (e.g., an *E. coli* sulfate binding protein) or a derivative or mutant thereof; (vii) a maltose binding protein (e.g., an *E. coli* maltose binding protein) or a derivative or mutant thereof; (viii) a glutamine binding protein (e.g., an *E. coli* glutamine binding protein) or a derivative or mutant thereof; (ix) a glutamate/aspartate binding protein (e.g., an *E. coli* glutamate/aspartate binding protein) or a derivative or mutant thereof; (x) a phosphate binding protein (e.g., an *E. coli* phosphate binding protein) or a derivative or mutant thereof; or (xi) an iron binding protein [e.g., a *Haemophilus influenza* (*H. influenzae*) iron binding protein] or a derivative or mutant thereof. For example, the second biosensor comprises an *E. coli* GGBP having a Y10C, Y10A, D14A, D14Q, D14N, D14S, D14T, D14E, D14H, D14L, D14Y, D14F, D14C, N15C, F16L, F16A, F16Y, F16C, N91A, K92C, E93C, S112A, S115A, E149C, E149K, E149Q, E149S, H152A, H152F, H152Q, H152N, H152C, D154A, D154C, D154N, A155S, A155H, A155L, A155F, A155Y, A155N, A155K, A155M, A155W, A155Q, A155C, R158A, R158K, R158C, M182C, M182W, W183C, W183A, N211F, N211W, N211K, N211Q, N211S, N211H, N211M, N211C, D212C, D236A, D236N, L238C, L255C, N256A, N256D, D257C, V293C, P294C, or V296C mutation (e.g., comprising 1, 2, 3, 4, 5 or more of these mutations), wherein each amino acid position is numbered as in (SEQ ID NO: 225); (ii) an *E. coli* arabinose binding protein having a D257C, F23C, K301C, L253C, or L298C mutation (e.g., comprising 1, 2, 3, 4, or 5 of these mutations) (see, e.g., U.S. Patent Application Publication No. 2004/0118681, the entire contents of which are incorporated herein by reference) (see, e.g., U.S. Patent Application Publication No. 2004/0118681, the entire contents of which are incorporated herein by reference); (iii) an *E. coli* dipeptide binding protein having a D450C, K394C, R141C, S111C, T44C, or W315C mutation (e.g., comprising 1, 2, 3, 4, 5 or 6 of these mutations) (see, e.g., U.S. Patent Application Publication No. 2004/0118681, the entire contents of which are incorporated herein by reference); (iv) an *E. coli*, histidine binding protein having a E167C, K229C, V163C, Y230C, F231C, Y88C mutation (e.g., comprising 1, 2, 3, 4, 5 or 6 of these mutations) (see, e.g., U.S. Patent Application Publication No. 2004/0118681, the entire contents of which are incorporated herein by reference); (v) an *E. coli* ribose binding protein having a T135C, D165C, E192C, A234C, L236C, or L265C mutation (e.g., comprising 1, 2, 3, 4, 5 or 6 of these mutations) (see, e.g., U.S. Patent Application Publication No. 2004/0118681, the entire contents of which are incorporated herein by reference); (vi) an *E. coli* sulfate binding protein having a L65C, N70C, Q294C, R134C, W290C, or Y67C mutation (e.g., comprising 1, 2, 3, 4, 5 or 6 of these mutations) (see, e.g., U.S. Patent Application Publication No. 2004/0118681 the entire content of which is incorporated herein by reference); (vii) an *E. coli* maltose binding protein having a D95C, F92C, E163C, G174C, I329C, or S233C mutation (e.g., comprising 1, 2, 3, 4, 5 or 6 of these mutations) (see, e.g., U.S. Patent Application Publication No. 2004/0118681 the entire content of which is incorporated herein by reference); (viii) an *E. coli* glutamine binding protein having a N160C, F221C, K219C, L162C, W220C, Y163C, or Y86C mutation (e.g., comprising 1, 2, 3, 4, 5 or more of these mutations) (see, e.g., U.S. Patent Application Publication No. 2004/0118681 the entire content of which is incorporated herein by reference); (ix) an *E. coli* glutamate/aspartate binding protein having a A207C, A210C, E119C, F126C, F131C, F270C, G211C, K268C, Q123C, or T129C mutation (e.g., comprising 1, 2, 3, 4, 5 or more of these mutations) (see, e.g., U.S. Patent Application Publication No. 2004/0118681 the entire content of which is incorporated herein by reference); (x) an *E. coli* phosphate binding protein having a A225C, N223C, N226C, S164C, or S39C mutation (e.g., comprising 1, 2, 3, 4, or 5 of these mutations) (see, e.g., U.S. Patent Application Publication No. 2004/0118681 the entire content of which is incorporated herein by reference); or (xi) a *Haemophilus influenza* (*H. influenzae*) iron binding protein having a E203C, K202C, K85C, or V287C mutation (e.g., comprising 1, 2, 3, or 4 of these mutations) (see, e.g., U.S. Patent Application Publication No. 2004/0118681 the entire content of which is incorporated herein by reference). In various embodiments, the sample is suspected of comprising urea.

References and PDB[a] files for bPBP structures, genes, and ligand binding

| bPBP | crystal structure open form | crystal structure closed Form | DNA sequence | ligand affinity |
|---|---|---|---|---|
| arabinose BP | | Quiocho and Vyas, 1984 1ABE | Scripture et al., 1987 | Clark et al., 1982; Miller et al., 1983 |
| dipeptide BP | Nickitenko et al., 1995 1DPE | Dunten & Mowbray, 1995 1DPP | Abouhamad et al., 1991 | Guyer et al., 1986; Smith et al., 1999 |
| Glu/Asp BP | | | | Barash Halpern, 1975; Willis Furlong, 1975 |
| Fe(III) BP | Bruns et al., 2001 1D9V | Bruns et al., 1997 1MRP | Sanders et al., 1994 | Adhikari et al., 1995 |
| glucose BP | | Vyas et al., 1988; Vyas et al., 1994 1GLG | Scholle et al., 1987 | Anraku, 1968 |
| histidine BP | | Yao et al., 1994 1HSL | Joshi & Ames 1996 | Miller et al., 1983 |
| maltase BP | Sharff et al., 1992 1OMP | Spurlino et al., 1991; Quiocho et al., 1997 1ANF | Duplay et al., 1984 | Schwartz et al., 1976 |
| phosphate BP | Ledvina et al., 1996 1OIB | Luecke & Quiocho, 1990 1IXH | Magota et al., 1984 | Medveczky & Rosenberg, 1969 |
| glutamine BP | Hsiao et al., 1996 1GGG | Sun et al., 1998 1WDN | Nohno et al., 1986 | Weiner et al., 1971 |
| ribose BP | Bjorkman & Mowbray, 1998 1URP | Mowbray & Cole, 1992 2DRI | Groarke et al., 1983 | Willis & Furlong, 1974 |
| sulfate BP | | Pflugrath & Quiocho, 1985; He & Quiocho, 1993 1SBP | Hellinga & Evans, 1985 | Jacobson & Quiocho, 1988 |

[a]Protein Data Bank (Berman et al., 2000)
Abouhamad et al., Molec. Microbiol. 5: 1035-1047 (1991)
Adhikari et al., J Biol. Chem. 270: 25142-25149 (1995)
Anraku, J. Biol. Chem. 243: 3116-3122 (1968)
Barash & Halpern, Biochim. Biophys. Acta 386: 168-180 (1975)
Bjorkman Mowbray, J. Mol. Biol. 279: 651-664 (1998)
Bruns et al., Biochemistry 40: 15631-15637 (2001)
Bruns et al., Nat Struct. Biol. 4: 919-924 (1997)
Clark et al., Biochemistry 21: 2227-2233 (1982)
Dunten & Mowbray, Protein Sci. 4: 2327-2334 (1995)
Duplay et al., J. Biol. Chem. 259: 10606-10613 (1984)
Groarke et al., J. Biol. Chem. 258: 12952-12956 (1983)
Guyer et al., J. Bacteriol. 168: 775-779 (1986)
He & Quiocho, Protein Sci. 2: 1643-1647 (1993)
Hellinga & Evans, Eur. J. Biochem. 149: 363-373 (1985)
Hsiao et al., J. Mol. Biol. 262: 225-242 (1996)
Jacobson & Quiocho, J. Mol. Biol. 204: 783-787 (1988)
Joshi & Ames, GenBank Accession Number U47027 (1996)
Ledvina et al., Proc. Natl. Acad. Sci USA 93: 6786-6791 (1996)
Luecke & Quiocho, Nature 347: 402-406 (1990)
Magota et al., J. Bacteriol. 157: 909-917 (1984)
Medveczky &Rosenberg, Biochim. Biophys. Acta 192: 369-371 (1969)
Miller et al., J. Biol. Chem. 258: 13665-13672 (1983)
Mowbray & Cole, J. Mol. Biol. 225: 155-175 (1992)
Nickitehko et al., Biochemistry 34: 16585-16595 (1995)
Nohno et al., Molec. Gen. Genet. 205: 260-269 (1986)
Pflugrath & Quiocho, Nature 314: 257-260 (1985)
Quiocho et al., Structure 5: 997-1015 (1997)
Quiocho & Vyas, Nature 310: 381-386 (1984)
Sanders et al., Infect Immun. 62: 4515-4525 (1994)
Scholle et al., Molec. Gen. Genet 208: 247-253 (1987)
Scripture et al., J. Mol. Biol. 197: 37-46 (1987)
Schwartz et al., Eur. J. Biochem. 71: 167-170 (1976)
Sharff et al., Biochemistry 31: 10657-10683 (1992)
Smith et al, Microbiology 145: 2891-2901 (1999)
Spurlino et al., J. Biol. Chem. 266: 5202-5219 (1991)
Sun et al, J. Mol. Biol. 278: 219-229 (1998)
Vyas et al., Biochemistry 33: 4762-4768 (1994)
Vyas et al., Science: 242: 1290-1295 (1988)
Weiner et al., Arch. Biochem. Biophys. 142: 715-717 (1971)
Willis & Furlong, J. Biol Chem. 249: 6926-6929 (1974)
Willis & Furlong, J. Biol. Chem. 250: 2574-2580 (1975)
Yao et al., Biochemistry 33: 4769-4779 (1994)

Various types of samples may be used in methods provided herein. In non-limiting examples, a sample may comprise a reaction product, a buffer, and/or a solvent. In some embodiments, the solvent is an aqueous solvent. In some embodiments, the solvent comprises a non-polar solvent, a polar aprotic solvent, and/or a polar protic solvent. For example, a sample may comprise water, liquid ammonia, liquid sulfur dioxide, sulfuryl chloride, sulfuryl chloride fluoride, phosphoryl chloride, dinitrogen tetroxide, antimony trichloride, bromine pentafluoride, hydrogen fluoride, dimethyl sulfoxide, hexane, benzene, toluene, 1,4-dioxane, chloroform, diethyl ether, dichloromethane, N-methylpyrrolidone, tetrahydrofuran, ethyl acetate, acetone, dimethylformamide, acetonitrile, tormic acid, n-butanol, isopropanol, nitromethane, ethanol, methanol, and/or acetic acid.

In embodiments, a sample comprises a Newtonian liquid, a shear thickening liquid, a shear thinning liquid, a thixotropic liquid, a rheopectic liquid, or a Bingham plastic. In some implementations, a sample has a dynamic viscosity of at least about 0.5, 0.6, 0.7, 0.8, 0.9, 1, 1.1, 1.2, 1.3, 1.4, 1.5, or 2 pascal-seconds (Pa·s) or less than about 2, 1.5, 1.4, 1.3, 1.2, 1.1, 1, 0.9, 0.8, 0.7, 0.6, 0.5 Pa·s; and/or a kinematic viscosity of at least about 0.5, 0.6, 0.7, 0.8, 0.9, 1, 1.1, 1.2, 1.3, 1.4, 1.5, or 2 centistokes (cSt) or less than about 2, 1.5, 1.4, 1.3, 1.2, 1.1, 1, 0.9, 0.8, 0.7, 0.6, 0.5 cSt.

In various embodiments, the sample comprises a biological sample. The sample may comprise, e.g., a clinical sample (i.e., a sample collected in a clinical or veterinary setting, e.g., by or at the request or supervision or direction of a doctor, nurse, aid worker, or medic) and/or a physiological sample (a sample collected from an organism, e.g., a mammal such as a human). In certain embodiments, the biological sample comprises or has been provided or obtained from a skin surface or a mucosal surface. In some embodiments, the biological sample comprises a biological fluid. Non-limiting examples of biological fluids include sweat, tear fluid, blood, serum, plasma, interstitial fluid, amniotic fluid, sputum, gastric lavage, skin oil, milk, fecal matter, emesis, bile, saliva, urine, mucous, semen, lymph, spinal fluid, synovial fluid, a cell lysate, venom, hemolymph, and fluid obtained from plants such as the fluid transported in xylem cells or phloem sieve tube elements of a plant (e.g. sap).

The present subject matter also provides biosensors, methods, compositions, and devices useful for measuring the level of a ligand within a liquid solution or suspension or composition comprising cultured cells or tissue or a supernatant of such a solution or suspension, e.g., a sample of conditioned media or a sample of growth media in which a population of cells was cultured. In some embodiments, the sample is within a culture (e.g., inserted into a bioreactor) or provided from a media, culture, or reaction, e.g., in a bioreactor. For example, the sample may be within or provided from a fermenter such as a culture or culture supernatant from a fermentation reaction (e.g., an ongoing fermentation, such as during beer/wine production, the culture of cells in research settings, the production of a compound, etc.). Thus, the level of a ligand can be assayed at a timepoint of interest or at a series of timepoints over the duration of cell culture, e.g. continuously, in or from a reaction or culture. Bioreactors include devices or systems that support a biologically active environment. For example, a bioreactor may comprise a vessel in which a chemical process is carried out which involves organisms or biochemically active substances derived from such organisms. Such a process can either be aerobic or anaerobic. Organisms growing in bioreactors may be, e.g., submerged or suspended in liquid medium or may be attached to the surface of a solid medium. Submerged cultures may be suspended or immobilized. Suspension bioreactors can use a wider variety of organisms, since special attachment surfaces are not needed, and can operate at much larger scale than immobilized cultures. However, in a continuously operated process the organisms will be removed from the reactor with the effluent. Immobilization is a general term describing a wide variety of cell or particle attachment or entrapment. It can be applied to basically all types of biocatalysis including enzymes, cellular organelles, and cells (e.g., animal cells, plant cells, fungal cells, and bacterial cells). Immobilization is useful for continuously operated processes, since the organisms will not be removed with the reactor effluent, but is limited in scale because the cells are only present on the surfaces of the vessel. A bioreactor may also refer to a device or system meant to grow cells or tissues in the context of cell culture. The interrogation and/or monitoring of urea levels in such samples permits the evaluation of the status of growth of the cells or production of secreted products by the cells to inform harvest or feeding or other modification of the culture.

Aspects of the present subject matter relate to the use of methods and biosensors provided herein to detect contamination.

In some embodiments, the sample comprises an environmental sample. Depending on context, there are instances in which a biological sample may also be, or may be within, an environmental sample. In certain embodiments, an environmental sample comprises a solute obtained from a biological composition, such as bone, nail, hair, shell, or cartilage. In various embodiments, an environmental sample comprises a solute obtained from an environmental substance and/or an environmental surface. For example, the solute may be dissolved/obtained from the environmental substance and/or an environmental surface using an aqueous or nonaqueous solution. In some embodiments, an aqueous may optionally comprise a nonaqueous solvent (e.g., mixed with an aqueous solvent). Non-limiting examples of environmental substances include rock, soil, clay, sand, meteorites, asteroids, dust, plastic, metal, mineral, fossils, sediment, and wood. Non-limiting examples of environmental surfaces include the surface of a vehicle such as a civilian vehicle (e.g., a satellite, a bike, a rocket, an automobile, a truck, a motorcycle, a yacht, a bus, or a plane) or a military vehicle (e.g., a tank, an armored personnel carrier, a transport truck, a jeep, a mobile artillery unit, a mobile antiaircraft unit, a minesweeper, a Mine-Resistant Ambush Protected (MRAP) vehicle, a lightweight tactical all-terrain vehicle, a high mobility multipurpose wheeled vehicle, a mobile multiple rocket launch system, an amphibious landing vehicle, a ship, a hovercraft, a submarine, a transport plane, a fighter jet, a helicopter, a rocket, or an Unmanned Arial Vehicle), a drone, a robot, a building, furniture, or an organism other than a human. In some embodiments, the sample comprises an environmental fluid. Non-limiting examples of environmental fluids include marine water, well water, drinking well water, water at the bottom of well dug for petroleum extraction or exploration, melted ice water, pond water, aquarium water, pool water, lake water, mud, stream water, river water, brook water, waste water, treated waste water, reservoir water, rain water, and ground water. In some embodiments, waste water comprises sewage water, septic tank water, agricultural runoff, water from an area in which chemical or oil spill has or is suspected of having occurred (e.g., an oil spill into a marine environment), water from an area where a radiation leak has or is suspected of having occurred (e.g., coolant from a nuclear reactor), water within the plumbing of a building, water within or exiting a research facility, and/or water within or exiting a manufacturing facility such as a factory.

As used herein, "suspected" with respect to an event means that there has been at least one test (e.g., a test other than a method or assay provided herein), occurrence (e.g., that is likely to or that may cause the event such as an emergency, leak, accident, flood, earthquake, storm, fire, malfunction, sunk vessel, or crash), or report (e.g., by a witness, informant, or observer) that is consistent with the event having occurred.

In certain embodiments, the sample comprises a food or beverage additive and/or a food or beverage composition. In some embodiments, the food or beverage composition comprises a fermented composition. In various embodiments, the sample comprises a fluid obtained from a food composition. Alternatively or in addition, the sample may comprise a solute dissolved from a food composition. In some examples, a solute is or has been dissolved from a food composition with an aqueous or nonaqueous solution. In various implementations, an aqueous solution may optionally comprise a nonaqueous solvent. In certain embodiments, a sample comprises a food composition in semisolid or liquid form. Non-limiting examples of such compositions include yogurt, soup, ice cream, a broth, a puree, a shake, a smoothie, a batter, a condiment, a sauce, and any combination thereof. In some implementations, a sample is a food engineering process (e.g., obtained from a food design, storage, transport, or production process or from equipment intended to process, transport, or store food). A food composition may comprise, e.g., a plant or a composition isolated from a plant, and/or an animal or a composition isolated from an animal. In various embodiments, a sample comprises a beverage composition. Non-limiting examples of beverage compositions include soft drinks, fountain beverages, water, coffee, tea, milk, dairy-based beverages, soy-based beverages (e.g., soy milk), almond-based beverages (e.g., almond milk), vegetable juice, fruit juice, fruit juice-flavored drinks, energy drinks, sports and fitness drinks, alcoholic products, and beverages comprising any combination thereof. Non-limiting examples of beverage compositions comprising water include purified water (e.g., filtered water, distilled water, or water purified by reverse osmosis), flavored water, mineral water, spring water, sparkling water, tonic water, and any combination thereof. In various embodiments, the sample comprises alcohol. Non-limiting examples of such samples include samples comprising or obtained/provided from beer, malt beverages, liqueur, wine, spirits, and any combination thereof.

Aspects provide methods for detecting, determining, monitoring, or assaying urea levels during the manufacture and/or storage of a food composition. In some embodiments, the level of urea is detected to detect or monitor for food spoilage.

In some embodiments, a sample comprises a nutritional or supplement composition. In certain implementations, the nutritional or supplement composition comprises an omega-3 fatty acid, a vitamin, a mineral, a protein powder, or a meal supplement.

In certain embodiments, a biosensor is implanted in a subject's body. For example, a biosensor may be implanted in a subject's blood vessel, vein, eye, natural or artificial pancreas, alimentary canal, stomach, intestine, esophagus, or skin (e.g., within the skin or under the skin). In various embodiments, the biosensor is configured within or on the surface of a contact lens. In some embodiments, the biosensor is configured to be implanted in or under the skin. In non-limiting examples, the biosensor is implanted in a subject with an optode and/or a microbead. In certain embodiments, the biosensor generates a signal transdermally.

Aspects of the present subject matter provide a method for assaying the level of urea in a subject. The method may comprise contacting a biological sample from the subject with a biosensor for urea under conditions such that the biosensor binds to urea present in the biological sample. The biosensor comprises a reporter group that is attached to a urea-binding protein, and binding of urea to a urea-binding domain of the urea-binding protein causes a change in signaling by the reporter group. In various embodiments, the subject has, is suspected of having, or is undergoing routine testing for reduced kidney function, such as acute kidney injury or chronic kidney disease. In various embodiments, the subject has or is suspected of having, or is undergoing routine testing for a urinary tract obstruction, congestive heart failure or a recent heart attack, gastrointestinal bleeding, dehydration (e.g., resulting from not drinking enough fluids or for other reasons), shock, low blood pressure, a severe burn, toxicity from a medications, such as an antibiotics, or a high-protein diet. In some embodiments, the biological sample comprises blood, plasma, serum, sweat, tear fluid, or urine. In certain embodiments, the biological sample is present in or on the surface of the subject. In various implementations, the biosensor is applied onto or inserted into the subject. For example, the biosensor may be tattooed into the subject or is in or on a device that is implanted into the subject. In some embodiments, the biosensor may be present in or on a contact lens that is worn by the subject. Methods for determining the level of urea, e.g. in a subject who has or is suspected of having a disease or disorder associated with an abnormal urea level, may be performed without other testing related to the disease or disorder, or performed as part of a battery of clinical testing. In some embodiments, the level of urea is determined as part of a kidney function test. In some embodiments, the level of urea is determined to assess and/or monitor kidney function and/or the effectiveness of hemodialysis treatment.

As used herein, "suspected" with respect to a subject's condition (e.g., disease or injury) means that the subject has at least one symptom or test (e.g., a test other than an assay or method provided herein) that is consistent with the condition.

Elevated urea in a bodily fluid (e.g., in the blood) is associated with reduced kidney function.

In various embodiments, the subject has or is suspected of having reduced or impaired kidney function, acute kidney injury, and/or kidney disease (such as chronic kidney disease). In some embodiments, the biological sample comprises blood, plasma, serum, sweat, tear fluid, or urine. In certain embodiments, the biological sample is present in or on the surface of the subject. In various implementations, the biosensor is applied onto or inserted into the subject. For example, the biosensor may be tattooed into the subject or is in or on a device that is implanted into the subject. In some embodiments, the biosensor may be present in or on a contact lens that is worn by the subject. Methods for determining the level of urea, e.g. in a subject who has or is suspected of kidney dysfunction, may be performed without other testing or as part of a battery of clinical testing. In some embodiments, the method is performed as part of routine testing, e.g., during a doctor visit such as a physical. Thus, the present subject matter provides methods for detecting whether a subject has reduced kidney function. The method may comprise contacting a biological sample from the subject with a biosensor for urea under conditions such that the biosensor binds to urea present in the biological sample. The biosensor comprises a reporter group that is attached to a urea-binding protein, and binding of urea to a urea-binding domain of the urea-binding protein causes a change in signaling by the reporter group.

Any type of abnormal urea level may be assessed, monitored or detected using the compounds, compositions, and methods provided herein. Additionally, any subject who has or is at risk of a disease or injury associated with an abnormal urea level may be assessed and/or monitored using the compounds, compositions, and methods provided herein.

The present subject matter includes a method for monitoring the level of a ligand, comprising periodically or continuously detecting the level of the ligand, wherein detecting the level of the ligand comprises (a) providing or obtaining a sample; (b) contacting the sample with a biosensor for the ligand under conditions such that the ligand-binding protein of the biosensor binds to the ligand, and (c) detecting a signal produced by the biosensor.

Aspects of the present subject matter also provide a method for monitoring the level of a ligand (e.g., urea) in a subject, comprising periodically detecting the level of the ligand in the subject. Detecting the level of the ligand in the subject may comprise (a) providing or obtaining a biological sample from the subject; (b) contacting the biological sample with a biosensor for the ligand provided herein under conditions such that the ligand-binding protein of the biosensor binds to the ligand, if the ligand is present in the biological sample, and (c) detecting (i) a signal produced by a reporter group of the biosensor, or (ii) whether a signal is produced by a reporter group of the biosensor. The level of the ligand may be detected, e.g., at least once every 1, 2, 3, 6, or 12 hours, at least once every 1, 2, 3, or 4 days, at least once every 1, 2, or three weeks, or at least once every 1, 2, 3, 4, 6, or 12 months.

The present subject matter also provides a method for monitoring the level of a ligand in a subject. The method comprises (a) administering a biosensor provided herein or a device comprising a biosensor provided herein to the subject, wherein after administration the biosensor is in contact with a bodily fluid or surface that typically comprises the ligand, and (b) detecting (i) a signal produced by a reporter group of the biosensor continuously or repeatedly at intervals less than about 30 minutes (m), 15 m, 10 m, 5 m, 1 m, 30 seconds (s), 15 s, 10 s, 5 s, 1 s, 0.1 s, 0.001 s, 0.0001 s, or 0.00001 apart, and/or (ii) whether a signal is produced by a reporter group of the biosensor continuously or repeatedly at intervals less than about 30 m, 15 m, 10 m, 5 m, 1 m, 30 s, 15 s, 10 s, 5 s, 1 s, 0.1 s, 0.001 s, 0.0001 s, or 0.00001 apart.

Non-limiting aspects of continuously monitoring ligand levels are described in Weidemaier et al. (2011) Biosensors and Bioelectronics 26, 4117-4123 and Judge et al. (2011) Diabetes Technology & Therapeutics, 13(3):309-317, the entire contents of each of which are hereby incorporated herein by reference.

Also within various implementations is a composition comprising a purified urea-binding fluorescently-responsive sensor protein and a solid substrate, e.g., a particle, a bead such as a magnetic bead, or a planar surface such as a chip or slide, wherein the sensor protein is immobilized onto the solid substrate. In some embodiments, the biosensor is immobilized on a patch. In some embodiments, the patch comprises a polymer or copolymer comprising hydroxyethyl (meth)acrylate, a polyolefin, polyurethane, polystyrene, an ethylene/methacrylic acid copolymer, an ethylene/methyl methacrylate copolymer, a polyester, and/or a polyurethane. In some embodiments, the patch comprises a woven fabric, a knitted fabric, or a nonwoven fabric of a synthetic fiber and/or natural fiber. In certain embodiments, the patch has an adhesive layer. An exemplary solid substrate solid substrate comprises a cyclic olefin copolymer. In some embodiments, the urea-binding protein is thermostable.

A thermostable urea sensor protein is one in which the activity (urea binding) is retained after exposure to relatively high temperatures. For example, the urea sensor protein comprises a mid-point thermal melt transition greater than 30° C., greater than 40° C., greater than 50° C., greater than 60° C., greater than 70° C., greater than 80° C., greater than 90° C., or greater than 100° C., or about 30° C. to about 100° C., about 40° C. to about 100° C., about 50° C. to about 100° C., about 60° C. to about 100° C., about 70° C. to about 100° C., about 80° C. to about 100° C., or about 90° C. to about 100° C. In some embodiments, the sensor protein contains a single cysteine residue. In some embodiments, the single cysteine residue is located in a site of the ligand-binding protein, where it responds to ligand binding. In some examples, the protein comprises the amino acid sequence of SEQ ID NO: 32 (csUBP7_95C) or 98 (csUBP7_186C.20), and in some examples, a single cysteine is conjugated to Badan, Acrylodan, or a derivative thereof. For example, the derivative comprises a replacement of the two-ring naphthalene of Acrylodan or Badan with a three-ring anthracene, a fluorene, or a styrene. In other non-limiting examples, a single cysteine is conjugated to Alexa532. A reporter group is covalently bound to the single cysteine. In some situations, the solid substrate comprises a plurality of sensor proteins, each of which comprises a different dissociation constant ($K_d$) for urea, e.g., for detecting and quantifying urea levels across many ranges of concentrations.

The present subject matter also includes a composition comprising purified urea sensor protein with less than 65% identity and greater than 27% identity (e.g., 44-48% sequence identity) to any one of SEQ ID NOS: 1-22 or 212-222, wherein the sensor protein comprises a single cysteine residue, such that the sensor protein is immobilized onto the solid substrate. As described above, a reporter group is covalently bound to the single cysteine. In some example, the solid substrate comprises a plurality of sensor proteins, each of which comprises a different dissociation constant ($K_d$) for urea for sensing over a wide range or ranges of urea concentrations.

In some embodiments, a method of detecting the presence of or the quantity of urea in a test sample is carried out using the following steps: contacting the test sample with the biosensor or sensor protein/solid support construct to yield a complex of urea and the ligand-binding protein or biosensor protein; contacting the complex with an excitation light; measuring an emission intensity of the reporter group from at least two wavelengths; computing a ratiometric signal from the two (or more) wavelengths; and comparing the signal to a known urea binding curve of signals to identify the presence of or calculate the quantity of urea in the test sample. The test sample may be obtained from a variety of sources. For example, the test sample may be selected from a bodily fluid, a food, a beverage, or a bioreactor culture broth. The testing method may be carried out in vivo, e.g., using an implantable device or dermal patch, or ex vivo.

In various embodiments, the subject to be tested is a mammal, e.g., a primate (such as a human, a monkey, a chimpanzee, or a gorilla), a fish, a bird, a reptile, an amphibian, or an arthropod. In some embodiments, the subject is a fish, a cow, a pig, a camel, a llama, a horse, a race horse, a work horse, a goat, a rabbit, a sheep, a hamster, a guinea pig, a cat, a wolf, a dog (e.g., a pet dog, a work dog, a police dog, or a military dog), a rat, a mouse, a seal, a whale, a manatee, a lizard, a snake, a chicken, a goose, a swan, a duck, or a penguin.

Exemplary Devices and Compositions Comprising Biosensors

Aspects of the present subject matter provide a device comprising one or more biosensors provided herein. Such devices may be, e.g., wearable, implantable, portable, or fixed.

In some embodiments, the device is a nanoparticle or a microparticle comprising the biosensor. Non-limiting examples of devices include devices comprising a test strip, patch, plate, bead, or chip comprising a biosensor provided herein. In certain embodiments, a device may comprise a desiccated biosensor.

The present subject matter also provides a contact lens or a skin patch comprising a biosensor provided herein. In some embodiments, the biosensor is throughout the contact lens or skin patch or within a particular region or zone of a contact lens or skin patch (e.g., in one or more shapes (e.g., a square, circle, or star), dots, lines, or zones, located at the periphery or a portion of the periphery of a contact lens or patch). In some embodiments, the skin patch comprises an adhesive that facilitates attachment of the patch to the surface of skin.

Devices provided herein may include a variety of structural compositions. For example, many polymers (including copolymers), and plastics may be used. Non-limiting examples of compositions useful in certain devices include glass, polystyrene, polypropylene, cyclic olefin copolymers, ethylene-norbornene copolymers, polyethylene, dextran, nylon, amylase, paper, a natural cellulose, a modified cellulose, a polyacrylamide, gabbros, gold, and magnetite (as well as combinations thereof). In some embodiments, the device comprises a hydrogel, a cryogel, or a soluble gel. For example, the biosensor may be incorporated into or onto the hydrogel, cryogel, or soluble gel. In various embodiments, the device comprises a matrix comprising nanopores, micropores, and/or macropores. In certain embodiments, the surface of a device comprises a polymer. In an embodiment, the surface comprises the surface of a particle or a bead having a diameter of about 0.001-1, 0.001-0.1, 0.01-0.1, 0.001-0.01, 0.1-1, 0.1-0.5, or 0.01-0.5 centimeters (cm). For example, the particle comprises a nanoparticle or a microparticle.

Non-limiting examples of polymers include cyclic olefin copolymers, ethylene-norbornene copolymers, polylactic acid, polyglycolic acid, agarose, alginate, poly(lactide-co-glycolide), gelatin, collagen, agarose, natural and synthetic polysaccharides, polyamino acids, poly(lysine), polyesters, polyhydroxybutyrates, polyanhydrides, polyphosphazines, polyvinyl alcohol, polyalkylene oxide, polyethylene oxide, polyallylamines, polyacrylates, modified styrene polymers, poly(4-aminomethylstyrene), pluronic polyols, polyoxamers, polyuronic acid, polyvinylpyrrolidone, hydroxyethyl (meth)acrylate, polyolefins, polyurethane, polystyrene, ethylene/methacrylic acid copolymers, ethylene/methyl methacrylate copolymers, polyester, and polyurethane. In some embodiments, the patch comprises a woven fabric, a knitted fabric, or a nonwoven fabric of a synthetic fiber and/or natural fiber.

Non-limiting examples of temporary tattoo compositions for application to a subject's skin are discussed in U.S. Patent Application Publication No. 20090325221, published Dec. 31, 2009, and U.S. Pat. No. 6,428,797, the entire contents of each of which are incorporated herein by reference. Biosensor disclosed herein may be incorporated into any temporary tattoo or other composition for application to the skin. For example, a temporary tattoo decal for application to a subject's skin and configured to detect the presence of a ligand may comprise, e.g., a base paper or plastic; a water-soluble slip layer applied to the base paper or plastic; a temporary tattoo applied to the water-soluble release layer on the base paper, wherein the temporary tattoo comprises a biosensor disclosed herein; an adhesive layer overlying the temporary tattoo; and a protective sheet overlying the adhesive layer.

In some embodiments, the device comprises a plastic polymer comprising cyclic olefin copolymer (COC), such as e.g. TOPAS® COC. Several types of cyclic olefin copolymers are available based on different types of cyclic monomers and polymerization methods. Cyclic olefin copolymers are produced by chain copolymerization of cyclic monomers such as 8,9,10-trinorbom-2-ene (norbornene) or 1,2,3,4,4a, 5,8,8a-octahydro-1,4:5,8-dimethanonaphthalene (tetracyclododecene) with ethene (such as TOPAS Advanced Polymer's TOPAS, Mitsui Chemical's APEL), or by ring-opening metathesis polymerization of various cyclic monomers followed by hydrogenation (Japan Synthetic Rubber's ARTON, Zeon Chemical's Zeonex and Zeonor). See, e.g., International Union of Pure and Applied Chemistry (2005) *Purr. Appl. Chem.* 77(5):801-814. These later materials using a single type of monomer may be referred to as cyclic olefin polymers (COPs). A CAS Registry number for COC is 26007-43-2.

In some embodiments, the biosensor is covalently or noncovalently (e.g., electrostatically) attached to a surface of a device. In certain embodiments, the biosensor is attached to a surface of a device or is not attached to a surface of the device (e.g., the biosensor is physically present within the device as a component of a solution or powder but not chemically immobilized onto or into a device surface). For example, the biosensor may move within the confines of a device chamber.

A biosensor may be attached to a device via a variety or means, e.g., via attachment motif. In some embodiments, the attachment motif is attached to the N-terminus or the C-terminus of the biosensor. In certain embodiments, the biosensor is linked to an attachment motif via a covalent bond. In various embodiments, the biosensor is linked to the attachment motif via a linker. A non-limiting example of a linker is a polyglycine comprising 2, 3, 4, 5, or more glycines and optionally further comprising a serine. In some embodiments, the attachment motif comprises a polypeptide. Non-limiting examples of polypeptides useful in attachment moieties include hexahistidine peptides, hexalysine peptides, zinc-finger domains (ZF-QNKs), and disulfide-containing truncated zinc fingers (βZifs). An example of a hexalysine peptide comprises amino acids in the sequence of SEQ ID NO: 108, an example of a ZF-QNK comprises amino acids in the sequence of SEQ ID NO: 106, and an example of a βZif comprises amino acids in the sequence of SEQ ID NO: 105. In some embodiments, the attachment motif comprises a polypeptide that binds to plastic or cellulose.

The hexahistidine, hexalysine, βZif and QNK-ZF fusions enable FRSs to be immobilized onto chemically functionalized surfaces. Non-limiting aspects of chemically functionalized surfaces are discussed in Biju, V., 2014, *Chem Soc Rev,* 43, 744-64 and McDonagh, 2008, *Chem Rev,* 108, 400-422, the entire contents of which are incorporated herein by reference. Directed evolution methods have been used to develop peptides that bind directly to non-functionalized surfaces (Care, Bergquist and Sunna, 2015, *Trends Biotechnol*, 33, 259-68; Baneyx, 2007, *Curr. Opin. Biotechnol.*, 18, 312-317; Gunay and Klok, 2015, *Bioconjug Chem*, 26, 2002-15), including various plastics (Adey et al., 1995, *Gene*, 156, 27-31; Serizawa et al., 2005, *J Am Chem Soc*, 127, 13780-1; Serizawa, Sawada and Kitayama, 2007a, *Angew Chem Int Ed Engl*, 46, 723-6; Serizawa, Sawada and Matsuno, 2007b, *Langmuir*, 23, 11127-33; Serizawa, Techawanitchai and Matsuno, 2007c, *Chembiochem*, 8, 989-93; Matsuno et al., 2008, *Langmuir*, 24, 6399-403; Chen, Serizawa and Komiyama, 2011, *J Pept Sci*, 17, 163-8; Kumada, 2010, *J. Biosci. and BioEng.*, 109, 583-587; Date et al., 2011, *ACS Appl Mater Interfaces*, 3, 351-9; Vodnik, Strukelj and Lunder, 2012, *J. Biotech.*, 160, 222-228; Kumada, 2014, *Biochem. et Biophys. Acta*, 1844, 1960-1969; Ejima, Matsuno and Serizawa, 2010, *Langmuir*, 26, 17278-85), inorganic materials (Hnilova, 2012, *Soft Matter*, 8, 4327-4334; Care et al., 2015, *Trends Biotechnol*, 33, 259-68), nanoparticles (Avvakumova et al., 2014, *Trends Biotechnol*, 32, 11-20), and cellulosic paper (Guo et al., 2013, *Biomacromolecules*, 14, 1795-805). Such peptides, or natural material-binding domains (Oliveira et al., 2015, *Biotechnol Adv*, 33, 358-69), also can be fused to FRSs to direct site-specific, oriented immobilization on their target materials while preserving FRS function. For instance, plastic-binding peptides have been developed that direct immobilization on polystyrene (Adey et al., 1995, *Gene*, 156, 27-31; Serizawa et al., 2007c, *Chembiochem*, 8, 989-93; Kumada, 2010, *Biochem. et Biophys. Acta*, 1844, 1960-1969; Vodnik et al., 2012, *Anal Biochem*, 424, 83-6), polymethyl acrylate (Serizawa et al., 2005, *J Am Chem Soc*, 127, 13780-1; Serizawa et al., 2007a, *Angew Chem Int Ed Engl*, 46, 723-6; Serizawa et al., 2007b, *Langmuir*, 23, 11127-33; Kumada, 2014, *Biochem. et Biophys. Acta*, 1844, 1960-1969), polycarbonate (Kumada, 2012, *J. Biotech.*, 160, 222-228), polylactide (Matsuno et al., 2008, *Langmuir*, 24, 6399-403), and polyphenylene vinylene (Ejima et al., 2010, *Langmuir*, 26, 17278-85). Cellulose-binding peptides (Guo et al., 2013, *Biomacromolecules*, 14, 1795-805) and natural domains (Oliveira et al., 2015, *Biotechnol Adv*, 33, 358-69; Shoseyov, Shani and Levy, 2006, *Microbiol Mol Biol Rev*, 70, 283-95) can be used to immobilize fusion proteins on paper. Inorganic material include noble metals (Hnilova, 2012, *Soft Matter*, 8, 4327-4334), semi-conductors (Care et al., 2015, *Trends Biotechnol*, 33, 259-68), and fluorescent quantum dots (Medintz et al., 2005, *Nat Mater*, 4, 435-46; Lee et al., 2002, *Science*, 296, 892-5). The entire contents of each of the references above (and all other references herein) is incorporated herein by reference.

In some embodiments, the attachment motif is attached to a device surface and/or within a matrix of the device. In some embodiments, a biosensor is attached to an attachment motif via a covalent bond and the attachment motif is attached to a device via a covalent bond. Non-limiting examples of covalent bonds include disulfide bonds, ester bonds, thioester bonds, amide bonds, and bonds that have been formed by click reactions. Non-limiting examples of a click reaction include a reaction between an azide and an alkyne; an azide and an alkyne in the presence of Cu(I); an azide and a strained cyclooctyne; an azide and a dibenzylcyclooctyne, a difluorooctyne, or a biarylazacyclooctynone; a diaryl-strained-cyclooctyne and a 1,3-nitrone; an azide, a tetrazine, or a tetrazole and a strained alkene; an azide, a tetrazine, or a tretrazole and a oxanorbornadiene, a cyclooctene, or a trans-cycloalkene; a tetrazole and an alkene; or a tetrazole with an amino or styryl group that is activated by ultraviolet light and an alkene.

Alternatively or in addition, a surface of a device may be modified to contain a moiety (e.g. a reactive group) what facilitates the attachment of a biosensor and/or binds to the biosensor. In some embodiments, the biosensor is attached to a surface via a biotin-avidin interaction.

In various implementations, the device comprises a first region or chamber for receiving a sample and a second region or chamber that comprises the biosensor, wherein the first region or chamber is separated from the second region or chamber by a filter. In some examples, the filter is impermeable to compounds greater than about 1, 2, 3, 4, 5, 10, 50, 200, or 250 kiloDalton (kDa) in size. The sample may comprise, e.g., a tube, such as a tube that is configured for centrifugation. When sample is placed into the first region and the device is centrifuged, then a portion of the sample comprising a ligand flows through the filter into the second region where the biosensor is contacted.

Non-limiting examples of devices provided herein include endoscopy probes and colonoscopy probes.

In some embodiments, the device comprises an optode. In non-limiting examples, the optode comprises an optical fiber and a single biosensor or composite biosensor. In certain embodiments, the single biosensor or composite biosensor is immobilized on the surface or at an end of the optical fiber. In some embodiments, the optode is configured for implantation into a subject. Alternatively or in addition, the optode is configured for insertion into a sample.

The devices provided herein may optionally comprise a biosensor panel, a composite sensor, a sensor array, and/or a composition comprising a plurality of biosensors. In various embodiments, a device comprises multiple urea biosensors that detect a range of different urea concentrations in a single sample and/or assay run (i.e., each biosensor has a different affinity for urea). Devices may provide spatial localization of multiple biosensors to provide the necessary addressability of different elements in a multi-sensor array comprising sensors that differ in their engineered affinities for coverage of a wide range of urea concentrations, or sensors that each detects distinct analytes.

Aspects of the present subject matter provide a biosensor panel comprising a plurality of biosensors, wherein the plurality of biosensors comprises at least one biosensor disclosed herein. In some embodiments, the plurality comprises at least about 2, 3, 4, 5, 10, 20, 30, 40, 50, 60, 70, 80, 90, or 100 biosensors.

The present subject matter also provides a composite sensor. The composite sensor may comprise a sensor element, wherein the sensor element comprises 2 or more biosensors, wherein at least 1 of the 2 or more biosensors is a biosensor disclosed herein. In some embodiments, the biosensors are not spatially separated in the sensor element, e.g., the biosensors are mixed within a solution, or immobilized on a surface of the sensor element. Alternatively, a mixture of different biosensors is physically present, e.g., loose, within a region or chamber of a sensor device/structure. In various embodiments, the composite sensor comprises a plurality of sensor elements, wherein each sensor element of the plurality of sensor elements comprises 2 or more biosensors, wherein at least 1 of the 2 or more biosensors is a biosensor provided herein. In some embodiments, the plurality of sensor elements comprises at least about 2, 3, 4, 5, 10, 20, 30, 40, 50, 60, 70, 80, 90, or 100 sensor elements.

Also included herein is a sensor array comprising a plurality of biosensors of the present subject matter. The sensor array may include, e.g., multichannel array or a multiplexed array. In some embodiments, the biosensors of the plurality of biosensors are spatially separated from each other. In certain embodiments, the biosensors are arranged linearly or in a grid on a surface of the array.

The present subject matter provides a composition comprising a plurality of biosensors including at least one biosensor disclosed herein. Also provided is a non-human mammal comprising a biosensor or device disclosed herein.

Exemplary Polypeptides and Polynucleotides

The present subject matter provides polynucleotides encoding any one of the polypeptides disclosed herein. The polypeptides are also provided. In various embodiments, the polynucleotides are codon-optimized for expression in a desired host cell, such as bacterial cells (e.g., E. coli), yeast, insect cells, plant cells, algal cells, or mammalian cells. The polypeptides provided herein include polypeptides comprising the amino acid sequence of any one of SEQ ID NOS: 1-104 or 212-222. The polynucleotides provided herein include polynucleotides encoding a polypeptide comprising the amino acid sequence of any one of SEQ ID NOS: 1-104 or 212-222.

The polypeptides and biosensors provided herein may be in a variety of forms, e.g., purified in solution, dried (e.g. lyophilized) such as in the form of a powder, and in the form of a crystal (e.g., a crystal suitable for x-ray crystallography). Thus, aspects of the present subject matter provide crystal structures and crystalized forms of the ligand-binding proteins and biosensors disclosed herein. Such crystal structures and crystalized proteins are useful for designing and optimizing biosensors using principles and methods discussed herein.

Also provided are expression vectors comprising a polynucleotide of the present subject matter and/or encoding a polypeptide disclosed herein. Non-limiting examples of expression vectors include viral vectors and plasmid vectors. In some embodiments, an expression vector comprises nucleotides in the sequence set forth as any one of SEQ ID NOS: 109-201. In various embodiments, a polynucleotide encoding a ligand-binding protein and/or biosensor is operably linked to a promoter. The promoter may be expressed, e.g., in a prokaryotic and/or a eukaryotic cell.

The subject matter further includes an isolated cell comprising an expression vector provided herein. The isolated cell may be, e.g., a bacterial cell, a yeast cell, an algal cell, a plant cell, an insect cell, or a mammalian cell. Also included is a non-human multicellular organism such as a plant or an animal (e.g., an insect, a mammal, a worm, a fish, a bird, or a reptile) comprising an expression vector disclosed herein.

Exemplary Methods for Designing Biosensors

Aspects of the present subject matter provide method of identifying a candidate ligand-binding protein for use in a biosensor, comprising: (a) selecting a first protein having a known amino acid sequence (seed sequence), wherein the first protein is known to bind urea; (b) identifying a second protein having an amino acid sequence (hit sequence) with at least 15% sequence identity to the seed sequence; (c) aligning the seed amino acid sequence and the hit sequence, and comparing the hit sequence with the seed sequence at positions of the seed sequence that correspond to at least 5 primary complementary surface (PCS) amino acids, wherein each of the at least 5 PCS amino acids has a hydrogen bond interaction or a van der Waals interaction with urea when urea is bound to the first protein; and (d) identifying the second protein to be a candidate ligand-binding protein if the hit sequence comprises at least 5 amino acids that are consistent with the PCS.

The present subject matter also includes a method for constructing a candidate biosensor, comprising: (a) providing a candidate ligand-binding protein; (b) generating a structure of the second protein; (c) identifying at least one putative allosteric, endosteric, or peristeric site of the second protein based on the structure; (d) mutating the second protein to substitute an amino acid at the at least one putative allosteric, endosteric, or peristeric site of the second protein with a cysteine; and (e) conjugating a fluorescent compound to the cysteine. In some embodiments, the structure comprises a homology model of the second protein generated using a structure of the first protein. In some embodiments, the structure comprises a structure experimentally determined by nuclear magnetic resonance spectroscopy or X-ray crystallography.

Aspects of the present subject matter further provide a method for constructing a biosensor comprising a desired dissociation constant ($K_d$) for urea, comprising: (a) providing an initial biosensor that does not comprise the desired $K_d$ for urea, wherein the initial biosensor is a biosensor provided herein; (b) mutating the initial biosensor to (i) alter a direct interaction in the PCS between the initial biosensor and bound urea; (ii) manipulate the equilibrium between open and closed states of the initial biosensor; (iii) alter an interaction between the ligand-binding protein and the reporter group of the initial biosensor; or (iv) alter an indirect interaction that alters the geometry of the binding site of the biosensor, to produce a modified biosensor; and (c) selecting the modified biosensor if the modified biosensor comprises the desired $K_d$ for urea. In some embodiments, the reporter group comprises Acrylodan, Badan, or a derivative thereof, and mutating the initial biosensor in (b) comprises altering an interaction between the ligand-binding protein and a carbonyl group of the Acrylodan, Badan, or derivative thereof. In some embodiments, the reporter group comprises Acrylodan, Badan, or a derivative thereof, and mutating the initial biosensor in (b) comprises altering an interaction between the ligand-binding protein and a naphthalene ring of the Acrylodan, Badan, or derivative thereof. In some embodiments, the reporter group comprises Acrylodan, Badan, or a derivative thereof, wherein the Acrylodan, Badan, or derivative thereof is attached to the amino acid of the urea-binding protein that aligns with position 26, 27, 30, 69, 90, 91, 95, 116, 157, 186, or 211 of csUBP7 (SEQ ID NO: 18 or 218) when the amino acid sequence of the urea-binding protein is aligned with the amino acid sequence of csUBP7 using the ClustalW alignment program. In certain embodiments, the reporter group comprises Alexa 532, and mutating the initial biosensor in (b) comprises altering an interaction between the urea-binding protein and the Alexa 532. In some embodiments, the reporter group comprises Alexa 532, wherein the Alexa 532 is attached to the amino acid of the urea-binding protein that aligns with position 26, 27, 30, 69, 90, 91, 95, 116, 157, 186, or 211 of csUBP7 (SEQ ID NO: 18 or 218) when the amino acid sequence of the urea-binding protein is aligned with the amino acid sequence of csUBP7 using the ClustalW alignment program.

In some embodiments, mutating the initial biosensor comprises introducing a substitution mutation into the initial biosensor. In some embodiments, the method further comprises immobilizing the affinity-tuned biosensor on a substrate.

In some embodiments, the second protein comprises (i) amino acids in the sequence of any one of SEQ ID NOS: 1-104 or 212-222; (ii) a stretch of amino acids in a sequence that is least about 95, 96, 97, 98, or 99% identical to the sequence of any one of SEQ ID NOS: 1-104 or 212-222; (iii) a stretch of at least about 50, 100, 150, 200, 250, 300, 350, or 400 amino acids in a sequence that is at least about 95, 96, 97, 98, or 99% identical to a sequence within any one of SEQ ID NOS: 1-104 or 212-222; or (iv) a stretch of at least about 50, 100, 150, 200, 250, 300, 350, or 400 amino acids in a sequence that is identical to a sequence within any one of SEQ ID NOS: 1-104 or 212-222. In various embodiments, attaching the reporter group to the putative allosteric, endosteric, or peristeric site of the first protein comprises substituting a cysteine at the site with a cysteine. For example, the reporter group is conjugated to the cysteine. Preferably, attaching a reporter group to the corresponding amino acid of the second protein produces a functional biosensor.

The selected first protein (e.g., the amino acid sequence thereof) may be novel or known. However, in many instances, the function of the first protein will not be known. In a non-limiting example, identifying a protein not previously known to have urea binding activity may comprise a structurally assisted functional evaluation (SAFE) homolog search method comprising the following steps:

(1) Collecting a sequence homology set using a BLAST sequence alignment tool starting with a urea-binding protein or a homologue thereof (paAmiC, avUBP, cgUBP, mpUBP1, mhUBP2, bsUBP3, dcUBP4, gtUBP5, ctUBP6, csUBP7, taUBP8, gkUBP10, psUBP11, or teUBP12) sequence disclosed herein as a seed. Permissive settings are used, such that pairwise hits are required to have a minimum of only, e.g., 20%, 25%, 30%, 35% or 40% sequence identity with the seed sequence. The lengths of the hit and seed are mutually constrained such that the alignment covers at least, e.g., 60%, 65%, 70%, 85%, or 90% within each partner.

(2) Structure-based encoding of biological function: A primary complementary surface (PCS) comprising the protein residues that form hydrogen bonds and van der Waals contacts with a bound urea is defined using computer-assisted, visual inspection of the three-dimensional structure of the protein-urea complex. This definition specifies residue positions and their permitted amino acid identity. Multiple amino acid identities are permitted at each position to encode functionally equivalent residues. This definition establishes a search filter for the accurate prediction of urea-binding proteins within the universe of sequence homologs collected in (1). For example, a candidate's residue corresponding to position 85 of paAmiC may be S or T, a candidate's residue corresponding to position 104 of paAmiC may be W, Y, or T, a candidate's residue corresponding to position 106 of paAmiC may be T, I, Q, V, or S, a candidate's residue corresponding to position 107 of paAmiC may be P, Q, E, F, L, Y, C, or W, a candidate's residue corresponding to position 150 of paAmiC may be Y, a candidate's residue corresponding to position 152 of paAmiC may be Y, F, V, or W, a candidate's residue corresponding to position 206 of paAmiC may be V, N, G, or L, and/or a candidate's residue corresponding to position 233 of paAmiC may be T, S, E, M, A, or C.

(3) Accurate sequence alignment: Tools such as ClustalW are used to construct an accurate alignment of all the sequence homologs. The seed sequence is included in the alignment. This multiple sequence alignment establishes the equivalent positions of the seed urea-binding protein (primary complementary surface) PCS in each sequence homolog.

(4) Function evaluation: The urea-binding properties of each of the aligned sequence homologs is determined by measuring their compliance with the PCS sequence filter. A "Hamming distance", H, is assigned for each homolog, which specifies the degree of sequence identity of all the residues at the aligned PCS positions. A value of H=0 indicates that the identities of all the residues at the aligned PCS positions match the amino acid(s) allowed in the PCS search filter; H>0, indicates that one or more aligned positions have disallowed residues. Sequences for which H=0 are predicted to encode urea-binding proteins.

(5) Selection of representative SAFE homologs: The sequence homologs are ordered by (a) identity with the seed PCS, as measured by the Hamming distance, (b) fractional overall sequence identity with the seed sequence. A subset for sequences with H=0, sampling the fractional overall sequence identity is selected for experimental verification.

In a non-limiting example, identifying a protein not previously known to have urea binding activity may comprise the following steps:

(1) performing a computational search of sequence databases to define a broad group of simple sequence or structural homologs of any known, urea-binding protein;

(2) using the list from step (1), deriving a search profile containing common sequence and/or structural motifs shared by the members of the list [e.g. by using computer programs such as MEME (Multiple Em for Motif Elicitation available at meme.sdsc.edu/meme/cgi-bin/meme.cgi) or BLAST];

(3) searching sequence/structural databases, using a derived search profile based on the common sequence or structural motif from step (2) as query (e.g., using computer programs such as BLAST, or MAST (Motif Alignment Search Tool available at meme.sdsc.edu/meme/cgi-bin/mast.cgi), and identifying a candidate sequence, wherein a sequence homology and/or structural similarity to a reference urea-binding protein is a predetermined percentage threshold;

(4) compiling a list of candidate sequences to generate a list of candidate urea-binding proteins;

(5) expressing the candidate urea-binding proteins in a host organism; and (6) testing for urea binding activity, wherein detection of urea binding in the organism (or the media thereof) indicates that the candidate sequence comprises a novel urea binding protein.

In non-limiting examples, the MEME suite of sequence analysis tools (meme.sdsc.edu/meme/cgi-bin/meme.cgi) can also be used as an alternative to BLAST. Sequence motifs are discovered using the program "MEME". These motifs can then be used to search sequence databases using the program "MAST." The BLAST search algorithm is well-known.

In various embodiments relating to alignments using a ClustalW alignment program, the ClustalW alignment program may be, e.g., ClustalW alignment program version 2.1.

Each embodiment disclosed herein is contemplated as being applicable to each of the other disclosed embodiments. Thus, all combinations of the various elements described herein are within the scope of the invention.

Other features and advantages of the invention will be apparent from the following description of the preferred embodiments thereof, and from the claims. Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below.

DESCRIPTION OF THE DRAWINGS

FIG. 1A: FRSs can be constructed by site-specifically attaching a fluorophore to a protein that undergoes a conformational change upon binding ligand (triangle) in a location between the two lobes of the protein (periplasmic binding protein or engineered derivative thereof), such that the shape and intensities of the fluorescent conjugate emission spectra changes. FIG. 1B: In the absence of ligand, the emitted fluorescence color is predominantly blue, whereas the ligand complex fluoresces green. Arrows indicate the direction of change upon ligand addition. FIG. 1C: The ligand dependence of the absolute blue and green intensities. FIG. 1D: The ratio of the blue and green emission intensities enables ligand binding to be determined.

FIG. 5A: Binned distribution of identity scores of hits using the paAmiC sequence as the search seed (f, the normalized count of sequences within a frequency score bin). Solid line: all sequences; broken line: the subset of sequences that match the urea-binding PCS (Hamming score, H=0). Note that the predicted urea-binding proteins tend to be distant homologs of paAmiC. FIG. 5B: Identity score distribution using the csUBP7 sequence as the search seed. Note that the subset of urea-binding proteins tends to be fairly closely related to the seed. FIG. 5C: Distribution of Hamming scores, H, within the set of csUBP7 homologs (N is the count with a particular H value). Note that (i) the majority of sequences are not urea-binding proteins (i.e. H>0), and (ii) the paucity of closely related PCS sequences (H=[1,2]).

FIG. 6 is an alignment of the selected lead sequences (see Table 4 for naming). Location of secondary structure elements is indicated. Leader peptides are indicated in grey. Dark grey indicates the sequence that was deleted in the mature protein expression constructs (note that for mpUBP1 and mhUBP2, this deletion extends two residues beyond the predicted boundary between the leader peptide and mature protein). Endogenous cysteines are shown (if present).

FIG. 7A: Structural alignment of csUBP7 and paAmiC. Urea is indicated. FIG. 7B: Primary complementary surface of csUBP7 (cf. FIG. 3). V113 has been omitted for clarity; it forms van der Waals contacts with the urea plane facing the viewer. FIG. 7C Sites of cysteine mutations (gray spheres) for covalent attachment of fluorophores.

FIG. 8 is a sequence comparison of the paAmiC and csUBP7 sequence and secondary structure element alignments. Numbering according to paAmiC.

FIG. 9 is an alignment showing the location of cysteine mutations for attachment of thiol-reactive fluorophores in csUBP7, ctUBP6, and bsUBP3. The aligned sequences of the proteins in the expression constructs are shown (sequence numbering according to csUBP7). The locations and structural classes of the cysteine mutations are indicated: e, endosteric; a, allosteric; p, peristeric. Underline indicates a position for which at least one conjugate in one homolog responded to urea binding. The mutations listed in Tables 7 and 8 are outlined in grey.

FIGS. 10A-F are graphs showing temperature- and urea-dependent ratiometric fluorescent landscapes of responsive and non-responsive fluorescent conjugates of csUBP7. Data was collected on a Roche LightCycler real-time PCR instrument, recording emission intensities at 488 nm and 580 nm as a function of temperature and urea concentration. FIGS. 10A-C correspond to csUBP7 186C·Acrylodan that responds to urea binding and exhibits thermal denaturation ($T_m$=364 K), FIGS. 10D-F: csUBP7 158C·Acrylodan exhibits a thermal denaturation transition ($T_m$=360 K), but does not report on urea binding. First row, temperature melts of 12 different urea concentrations. FIG. 10A inset shows the isothermal urea-binding curve for the responsive conjugate csUBP7 186C·Acrylodan, with a $^{true}K_d$ of 0.4 mM at 298 K (25° C.). Second and third row; three-dimensional landscapes representing the ratio of fluorescence emission intensities (Z axis) at 488 nm and 580 nm as a function of temperature and urea concentration. Indicated are the main equilibrium states: N, native apo-protein; D, denatured protein; S, saturated urea complex.

FIG. 11A: Emission spectra. Purple, no urea; red, saturating urea; black, intermediate urea concentrations; arrows, change in intensity with increased urea concentration. FIG. 11B: Dichromatic signal ($\lambda_1$=479 nm, $\lambda_2$=510 nm; black circles, experimental data points; gray lines, fit to binding isotherm, $^{app}K_d$=2.1 mM, see Table 6). FIG. 11C: Monochromatic signal (gray, 479 nm data points and fit; black, 510 nm data points and fit; $^{true}K_d$=2.2 mM).

FIG. 13A: Emission spectra. Purple, no urea; red, saturating urea; black, intermediate urea concentrations; arrows, change in intensity with increased urea concentration. FIG. 13B: Structure of Alexa532. Arrow indicates site possible carbonyl twist.

FIG. 15A: Urea titration curve determined for magnetic Ni-NTA beads coated with immobilized csUBP7 95C·Badan. Dichromatic signal ($\lambda_1$=483 nm, $\lambda_2$=525 nm); circles, experimental data points; gray lines, fit to binding isotherm, $^{app}K_d$=2.0 mM. FIGS. 15B-D: Thermostability was determined by measuring the ratio fluorescence emission intensities through 488 nm and 510 nm filters as a function of temperature in a Roche LightCycler. FIG. 15B: Solution ($T_m$=352 K). FIG. 15C: Immobilized on Ni-NTA beads ($T_m$=352 K). FIG. 15D: Reconstituted, desiccated Ni-NTA beads ($T_m$=352 K).

FIG. 12A: Simplified Jablonski diagram illustrating radiative and non-radiative pathways in the donor and acceptor. The donor excited state (D*) is formed through illumination by the excitation source (wavy arrow) whereas the acceptor excited state (A*) is formed by resonance energy transfer (dashed arrow). The fluorescence intensity is determined by the ratio of radiative decay (gray arrows) of the excited states (gray lines) to the ground state (black line) relative to all non-radiative processes (black arrows), and the resonance energy transfer rate, $k_t$, from donor to acceptor.

FIG. 17 shows the sequence of an exemplary mpUBP1 expression construct (SEQ ID NO: 109).

Figure 18:
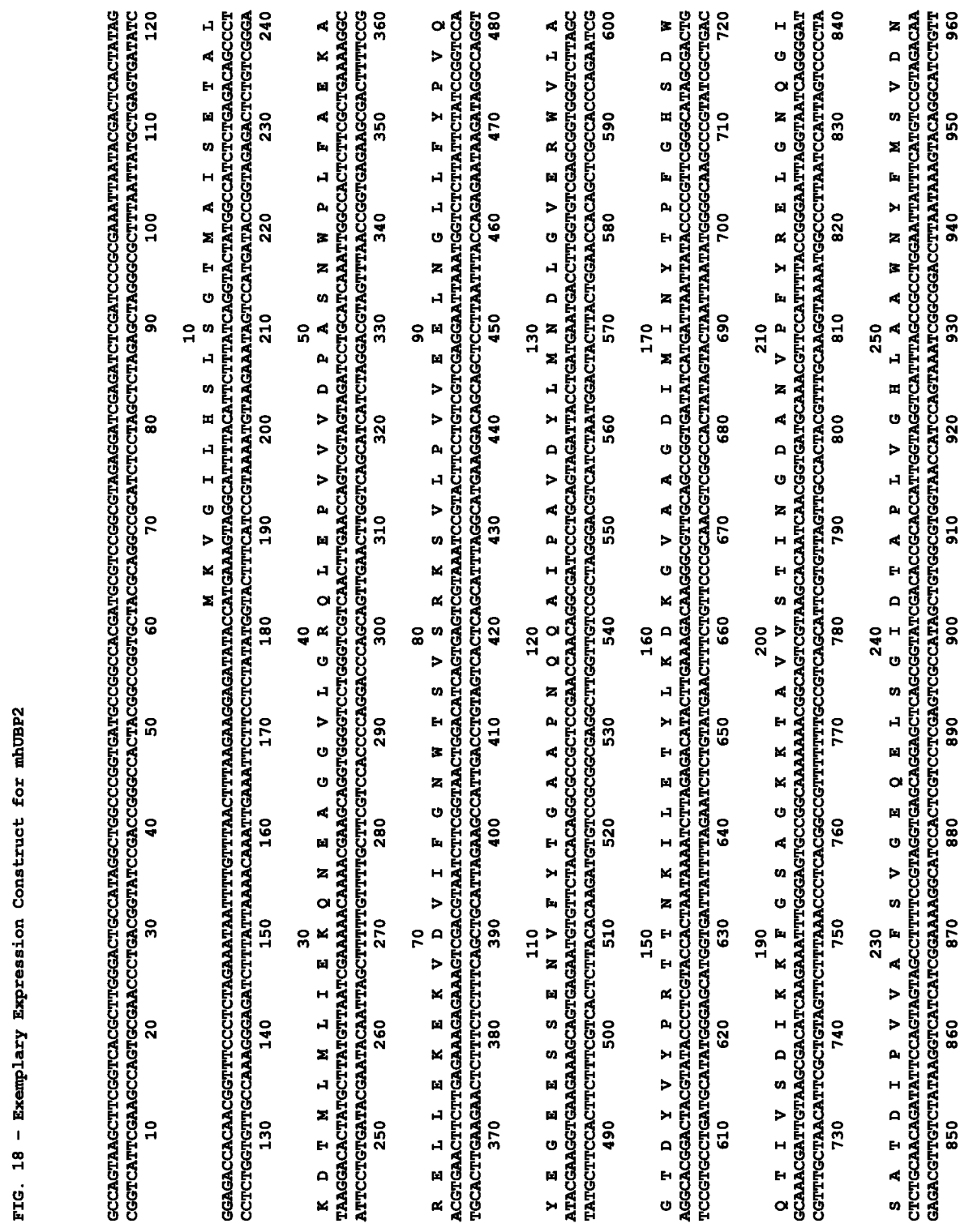

FIG. 18 shows the sequence of an exemplary mhUBP2 expression construct (SEQ ID NO: 110).

FIG. 19 shows the sequence of an exemplary bsUBP3 expression construct (SEQ ID NO: 111).

FIG. 20 shows the sequence of an exemplary dcUBP4 expression construct (SEQ ID NO: 112).

FIG. 21 shows the sequence of an exemplary gtUBP5 expression construct (SEQ ID NO: 113).

FIG. 22 shows the sequence of an exemplary ctUBP6 expression construct (SEQ ID NO: 114).

FIG. 23 shows the sequence of an exemplary csUBP7 expression construct (SEQ ID NO: 115).

FIG. 24 shows the sequence of an exemplary taUBP8 expression construct (SEQ ID NO: 116).

FIG. 25 shows the sequence of an exemplary gkUBP10 expression construct (SEQ ID NO: 117).

FIG. 26 shows the sequence of an exemplary psUBP11 expression construct (SEQ ID NO: 118).

FIG. 27 shows the sequence of an exemplary teUBP12 expression construct (SEQ ID NO: 119).

FIG. 28 shows the sequence of an exemplary csUBP7_26C expression construct (SEQ ID NO: 120).

Figure 29:
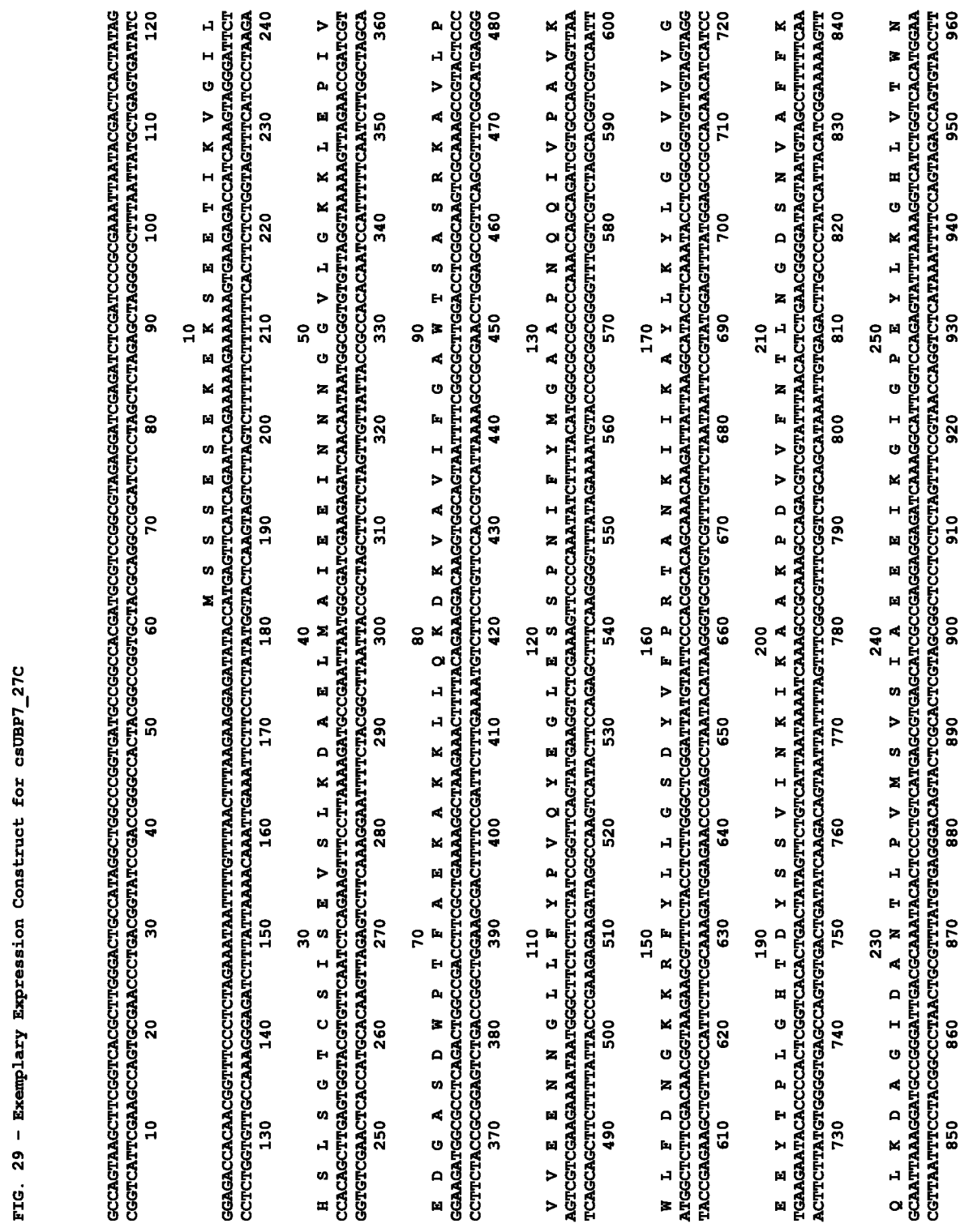

FIG. 29 shows the sequence of an exemplary csUBP7_27C expression construct (SEQ ID NO: 121).

FIG. 30 shows the sequence of an exemplary csUBP7_30C expression construct (SEQ ID NO: 122).

FIG. 31 shows the sequence of an exemplary csUBP7_65C expression construct (SEQ ID NO: 123).

Figure 32:
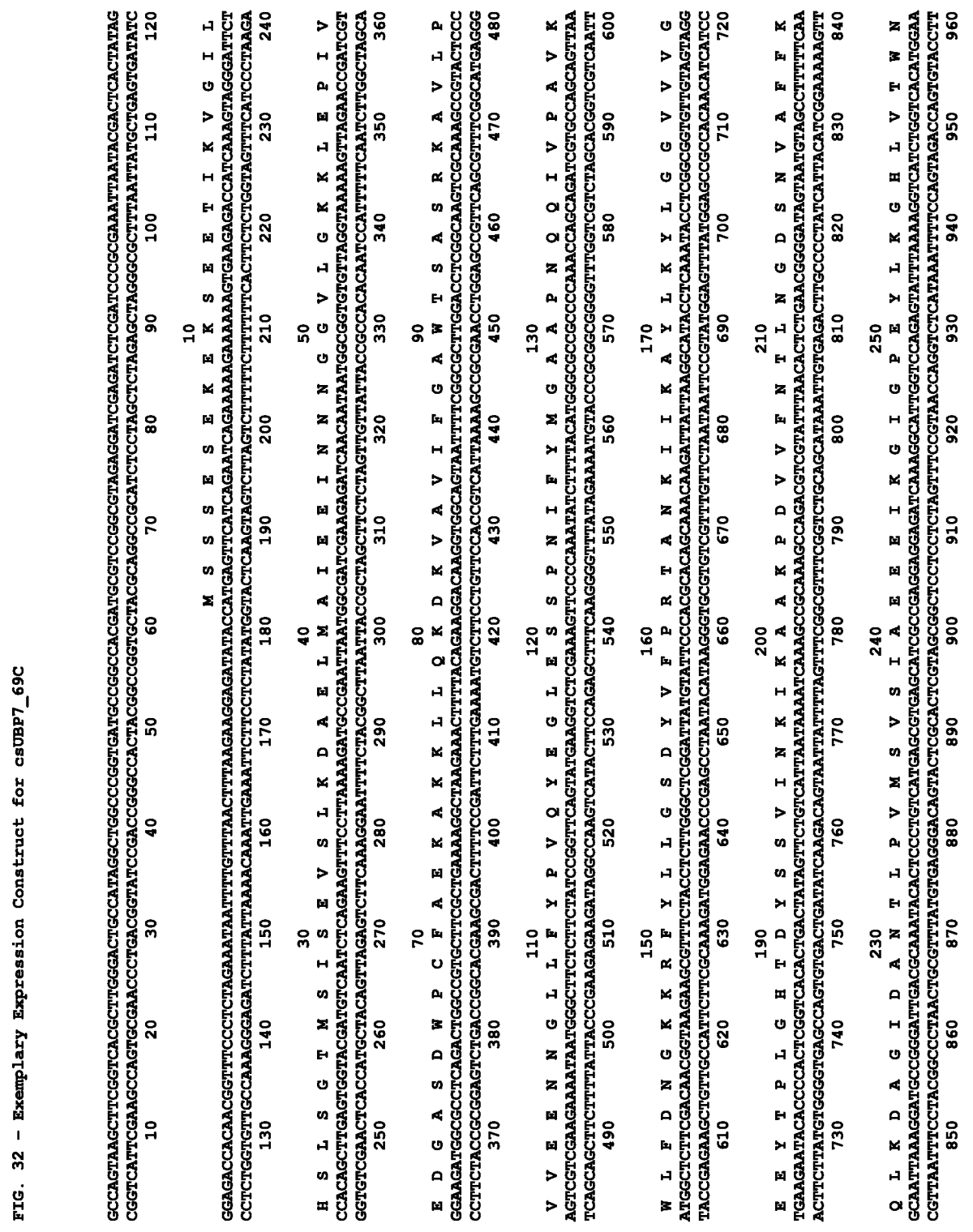

FIG. 32 shows the sequence of an exemplary csUBP7_69C expression construct (SEQ ID NO: 124).

Figure 33:
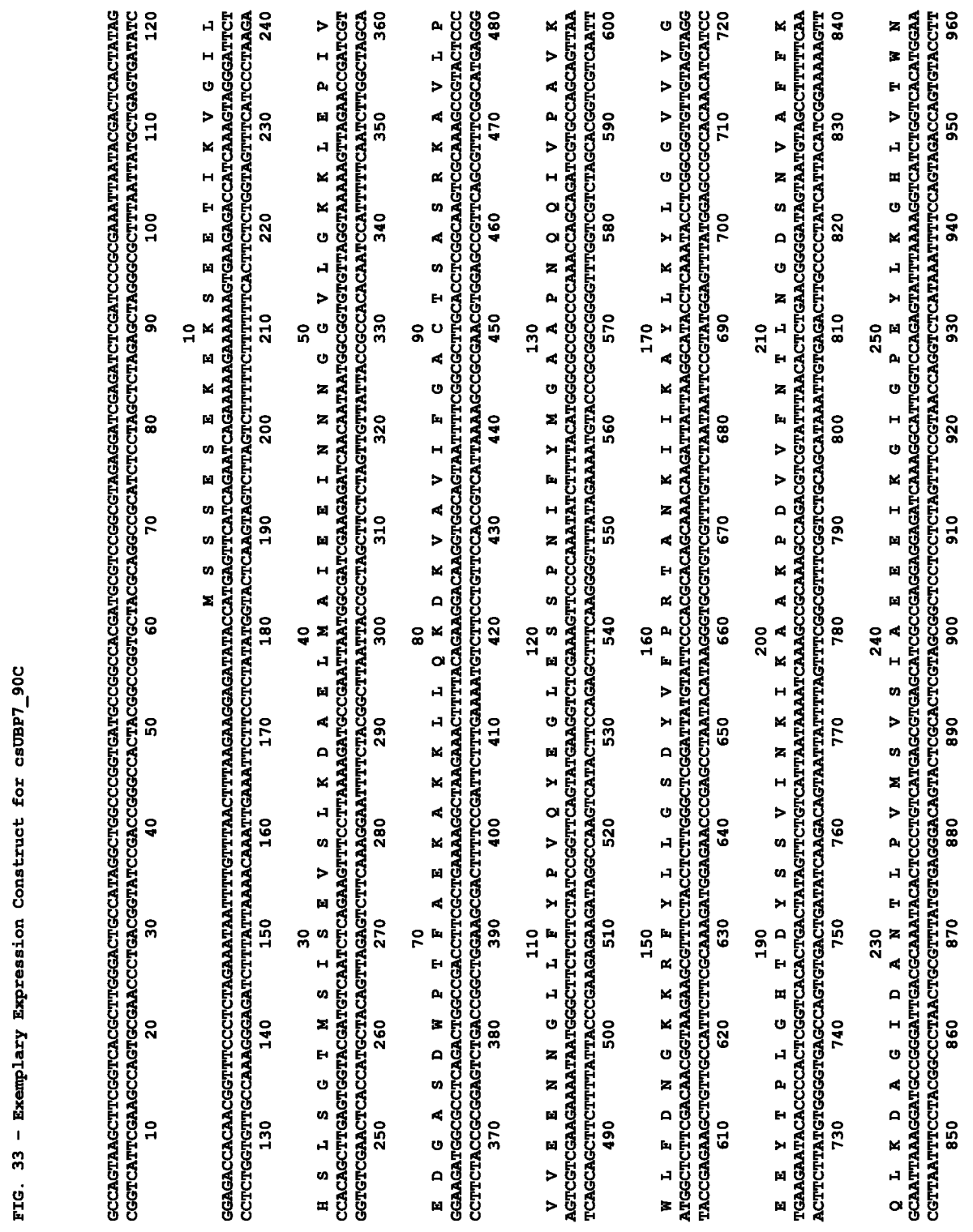

FIG. 33 shows the sequence of an exemplary csUBP7_90C expression construct (SEQ ID NO: 125).

FIG. 34 shows the sequence of an exemplary csUBP7_92C expression construct (SEQ ID NO: 126).

Figure 35:
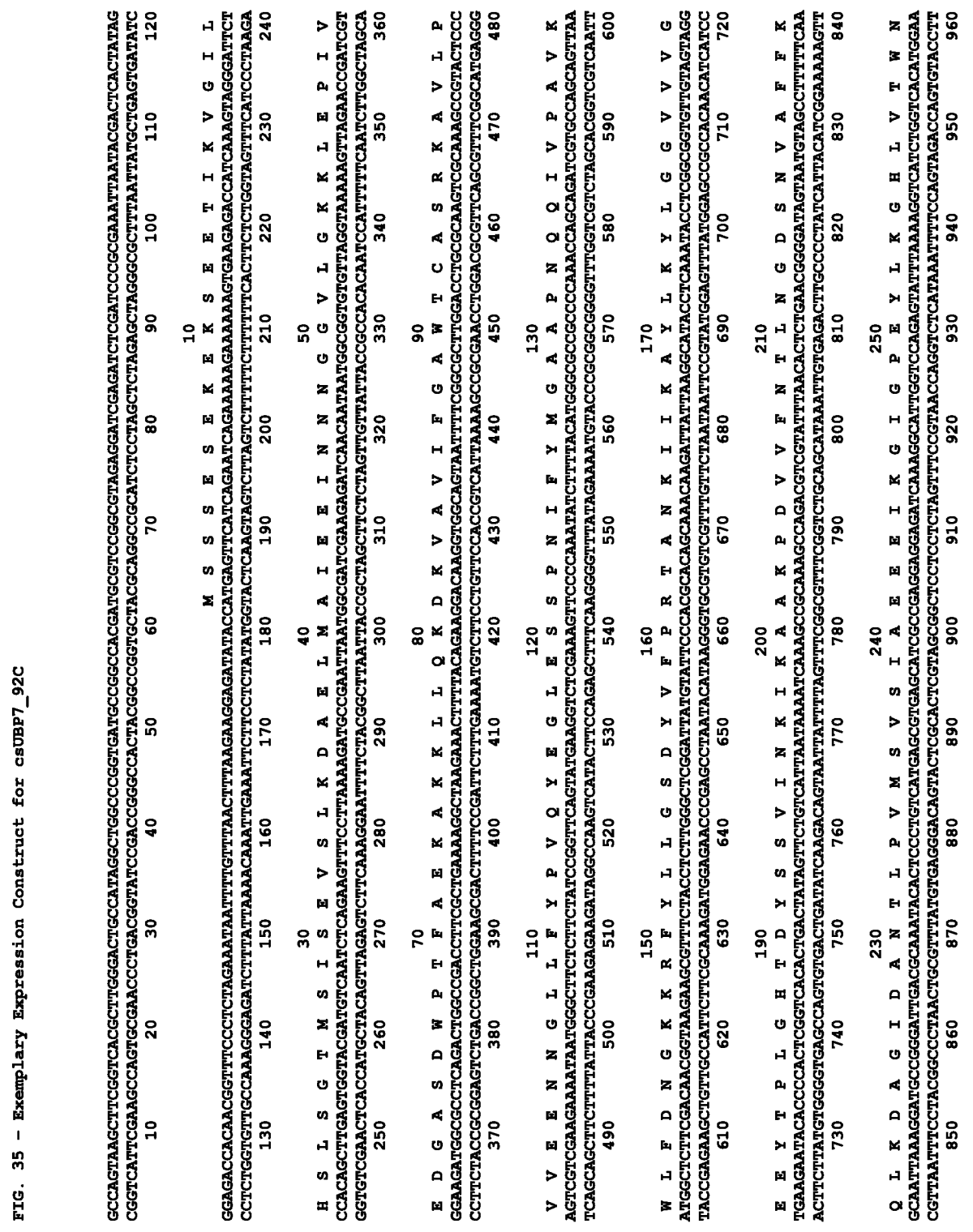

FIG. 35 shows the sequence of an exemplary csUBP7_92C expression construct (SEQ ID NO: 127).

FIG. 36 shows the sequence of an exemplary csUBP7_93C expression construct (SEQ ID NO: 128).

FIG. 37 shows the sequence of an exemplary csUBP7_95C expression construct (SEQ ID NO: 129).

FIG. 38 shows the sequence of an exemplary csUBP7_111C expression construct (SEQ ID NO: 130).

Figure 39:
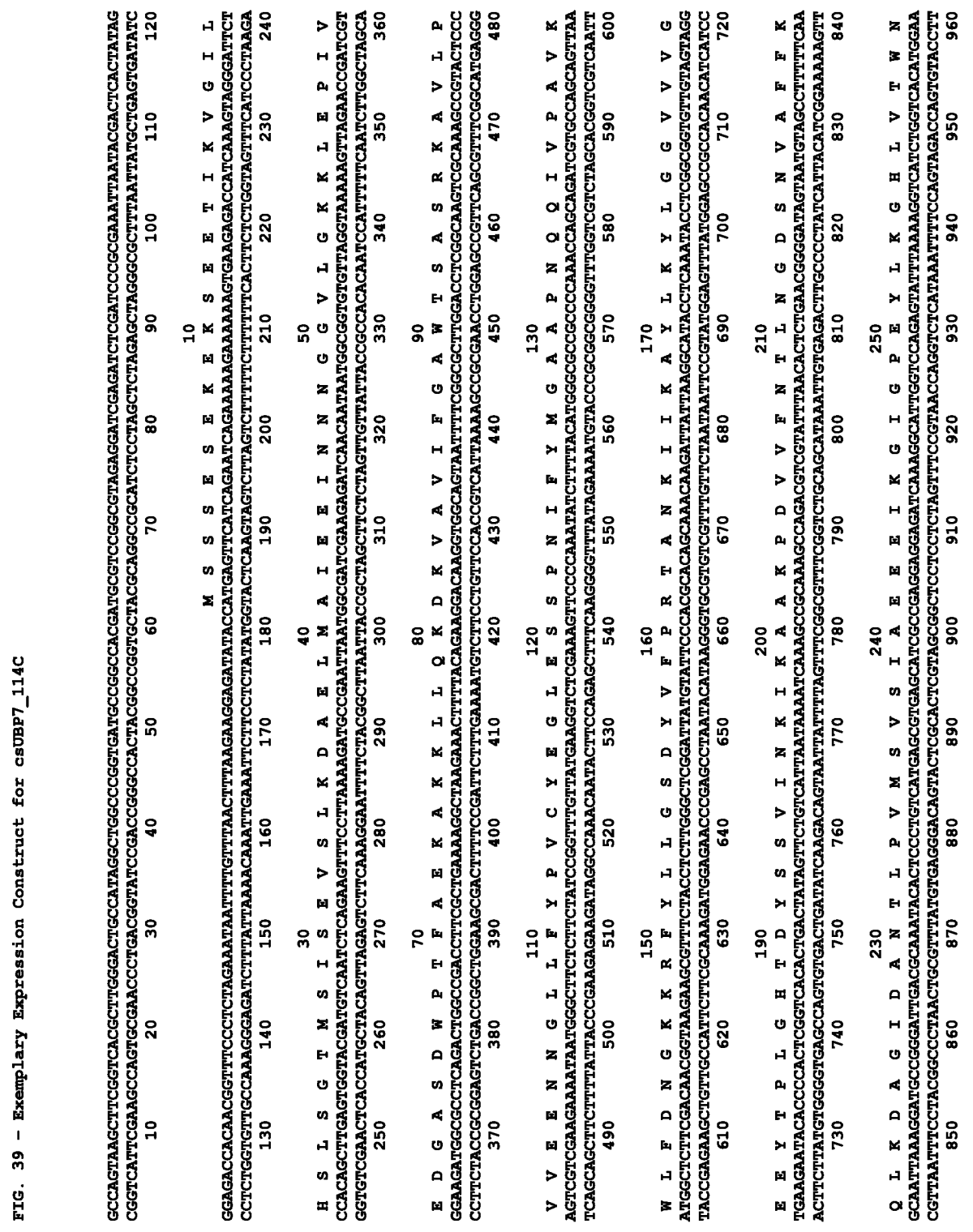

FIG. 39 shows the sequence of an exemplary csUBP7_114C expression construct (SEQ ID NO: 131).

Figure 40:
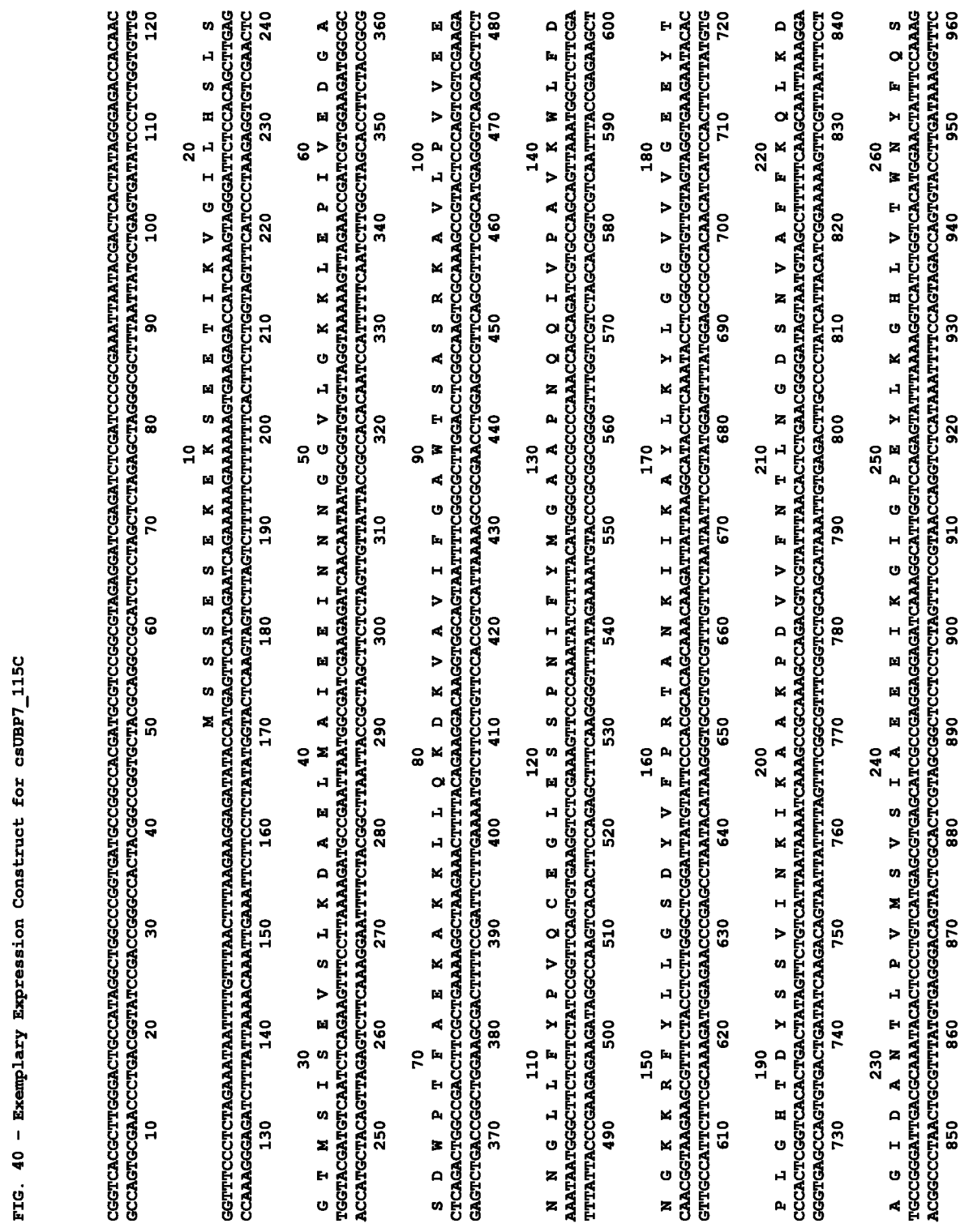

FIG. 40 shows the sequence of an exemplary csUBP7_115C expression construct (SEQ ID NO: 132).

Figure 41:
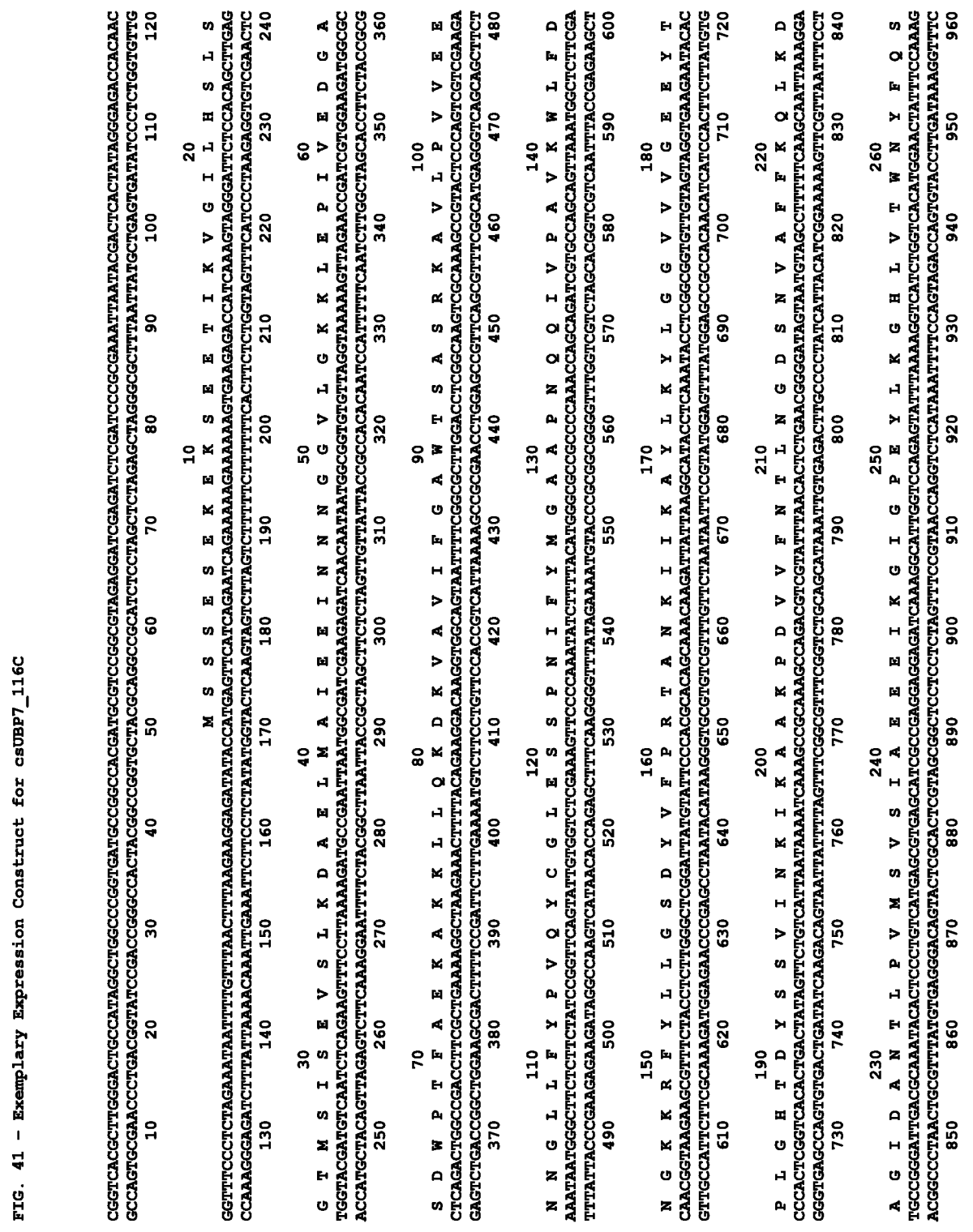

FIG. 41 shows the sequence of an exemplary csUBP7_116C expression construct (SEQ ID NO: 133).

Figure 42:
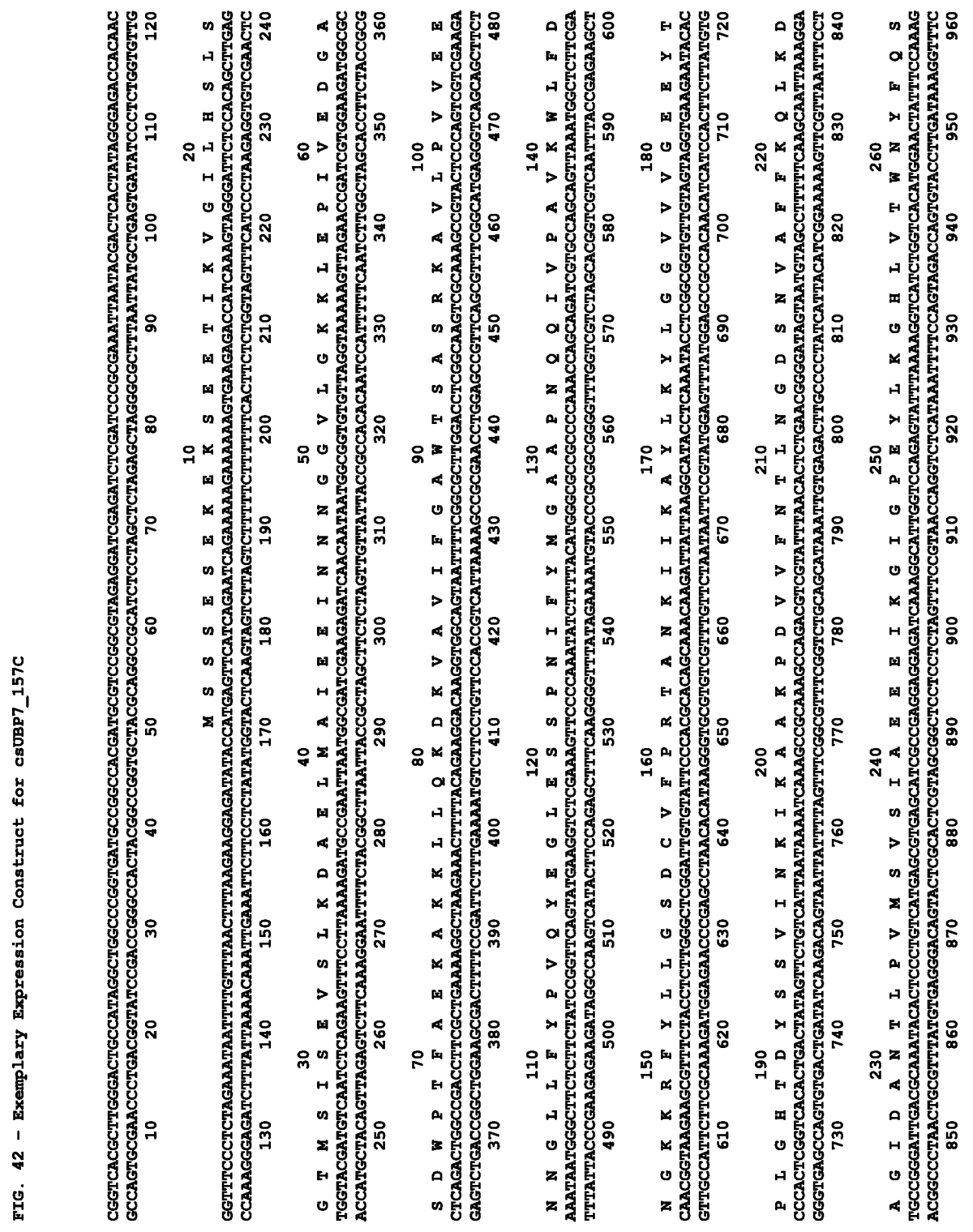

FIG. 42 shows the sequence of an exemplary csUBP7_157C expression construct (SEQ ID NO: 134).

Figure 43:
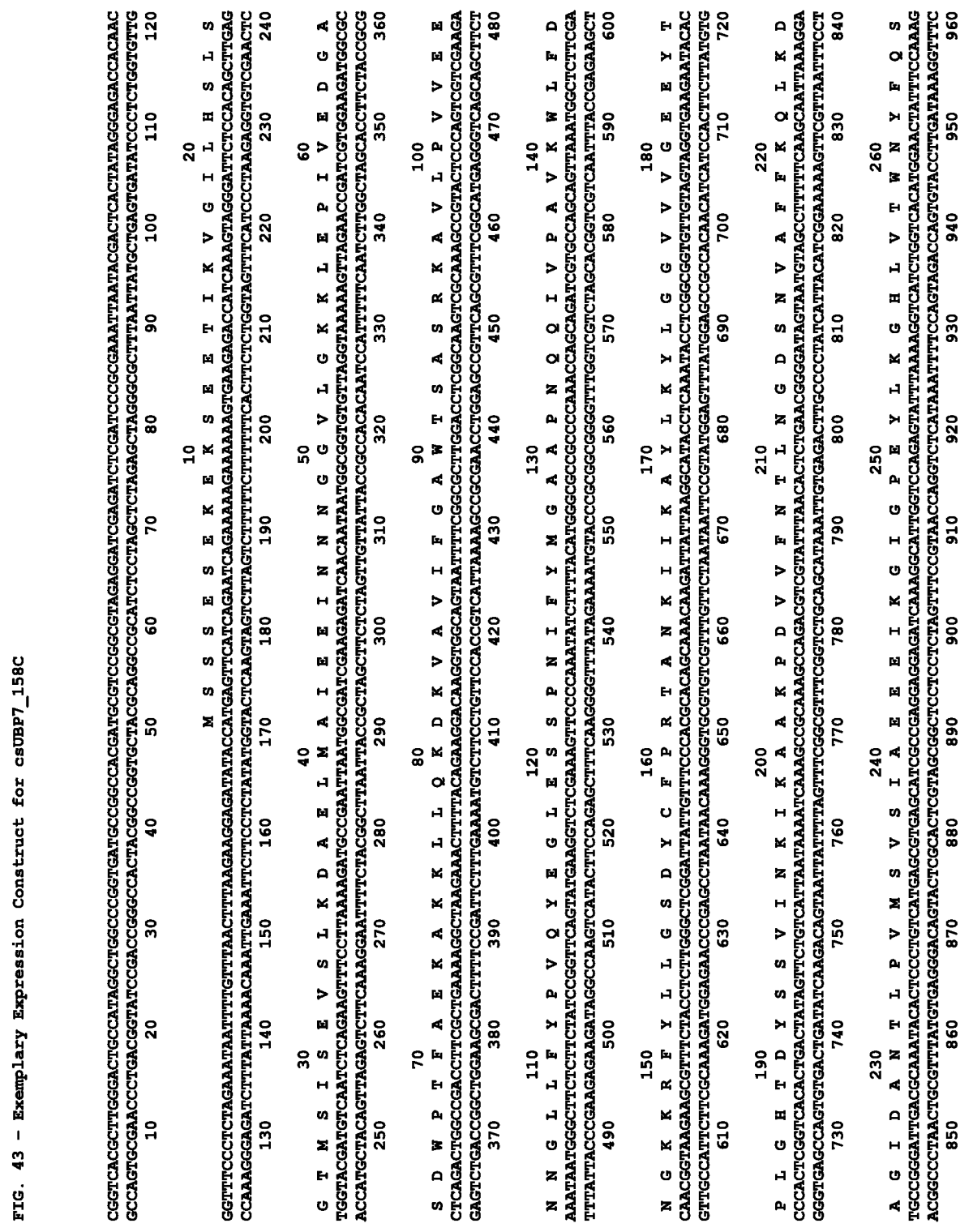

FIG. 43 shows the sequence of an exemplary csUBP7_158C expression construct (SEQ ID NO: 135).

FIG. 44 shows the sequence of an exemplary csUBP7_159C expression construct (SEQ ID NO: 136).

Figure 45:
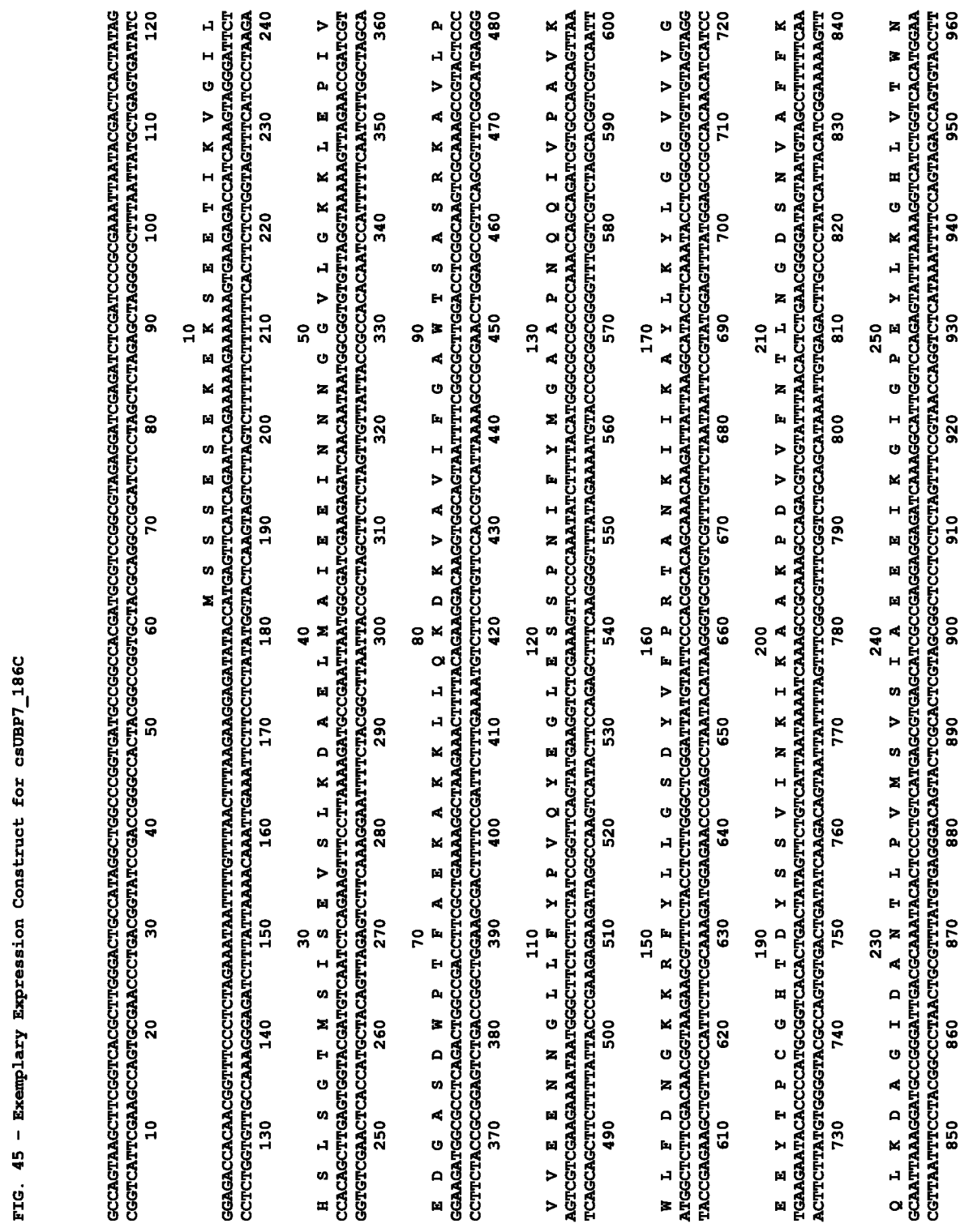

FIG. 45 shows the sequence of an exemplary csUBP7_186C expression construct (SEQ ID NO: 137).

Figure 46:
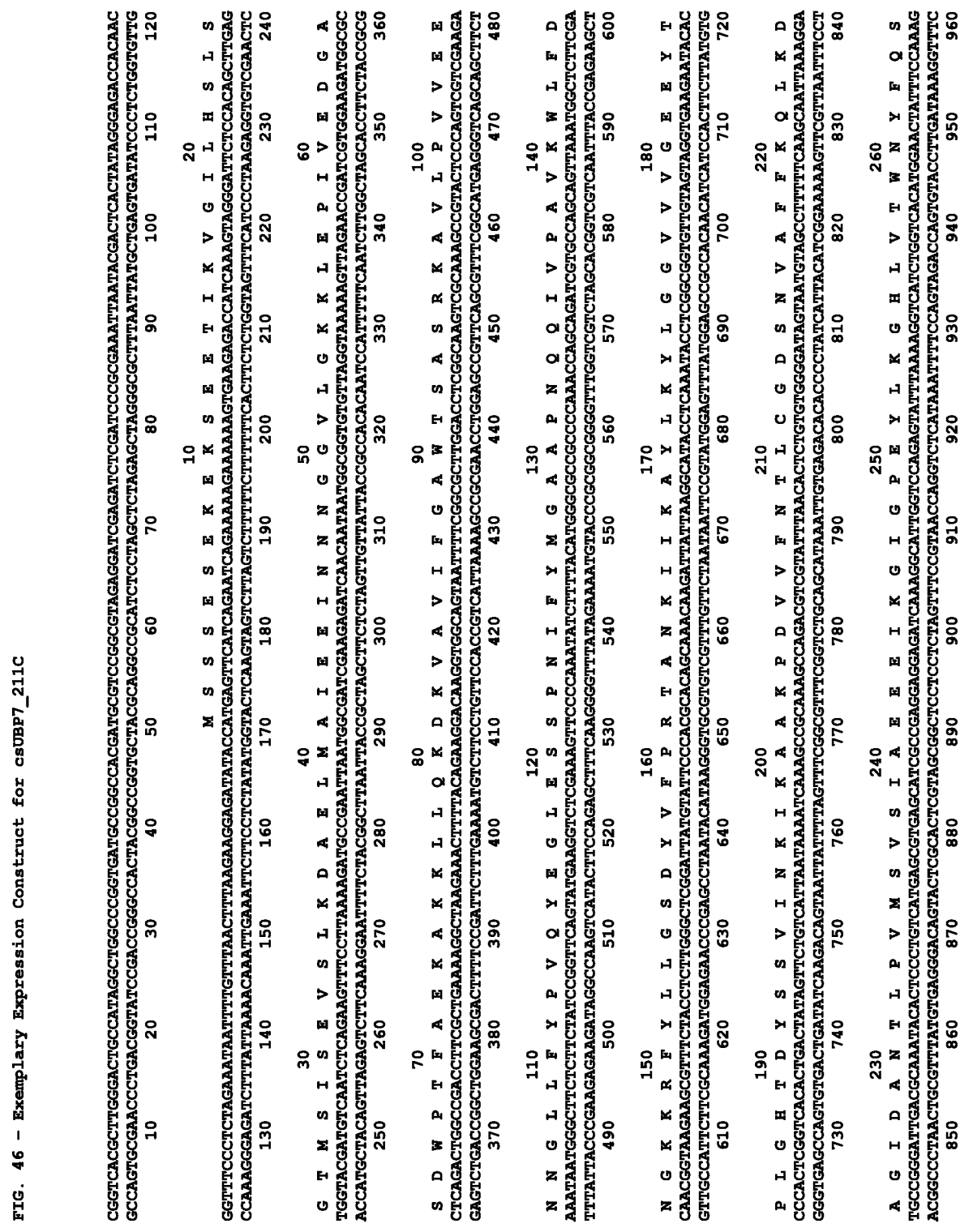

FIG. 46 shows the sequence of an exemplary csUBP7_211C expression construct (SEQ ID NO: 138).

Figure 47:
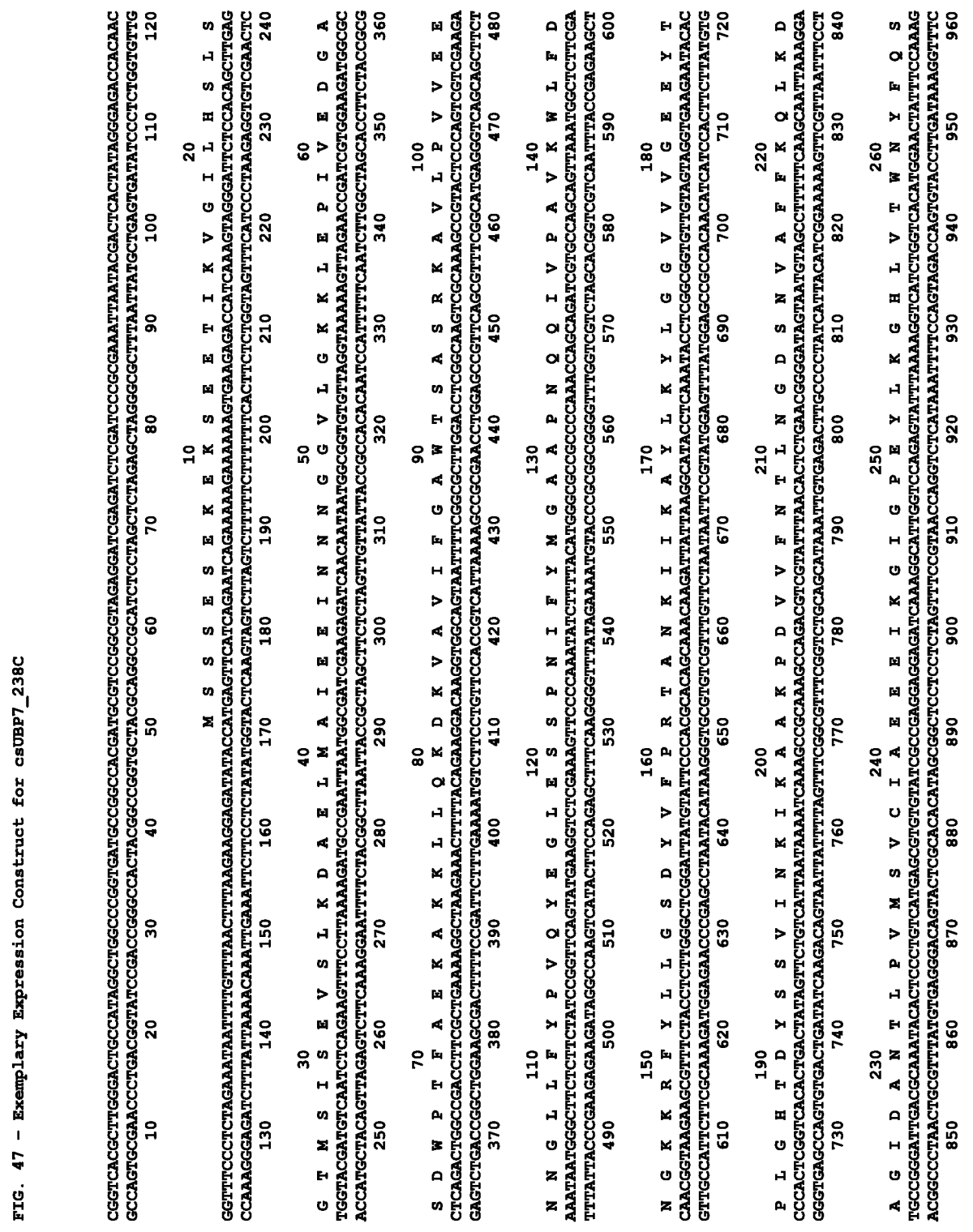

FIG. 47 shows the sequence of an exemplary csUBP7_238C expression construct (SEQ ID NO: 139).

FIG. 48 shows the sequence of an exemplary bsUBP3_76C expression construct (SEQ ID NO: 140).

Figure 49:
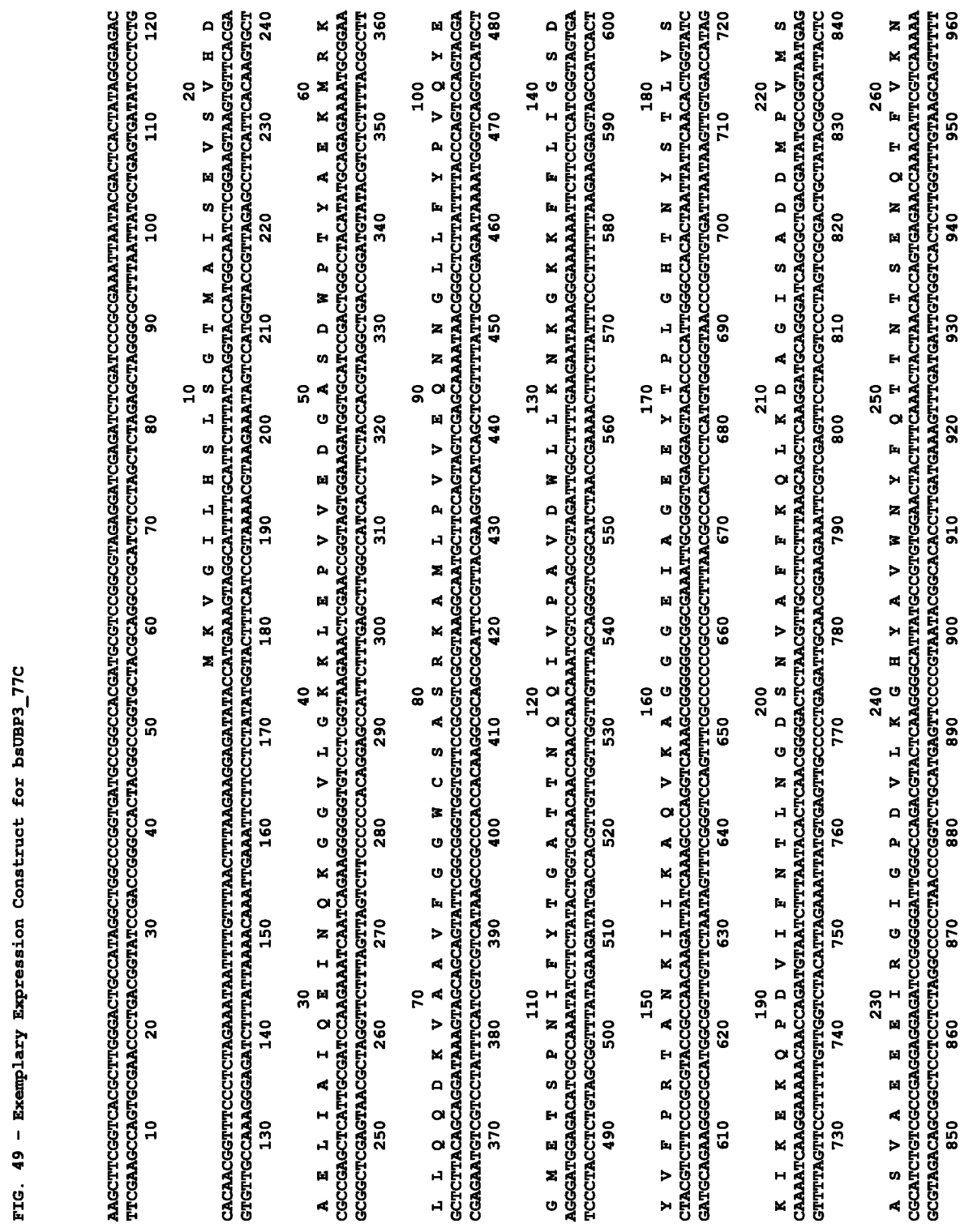
Figure 49:
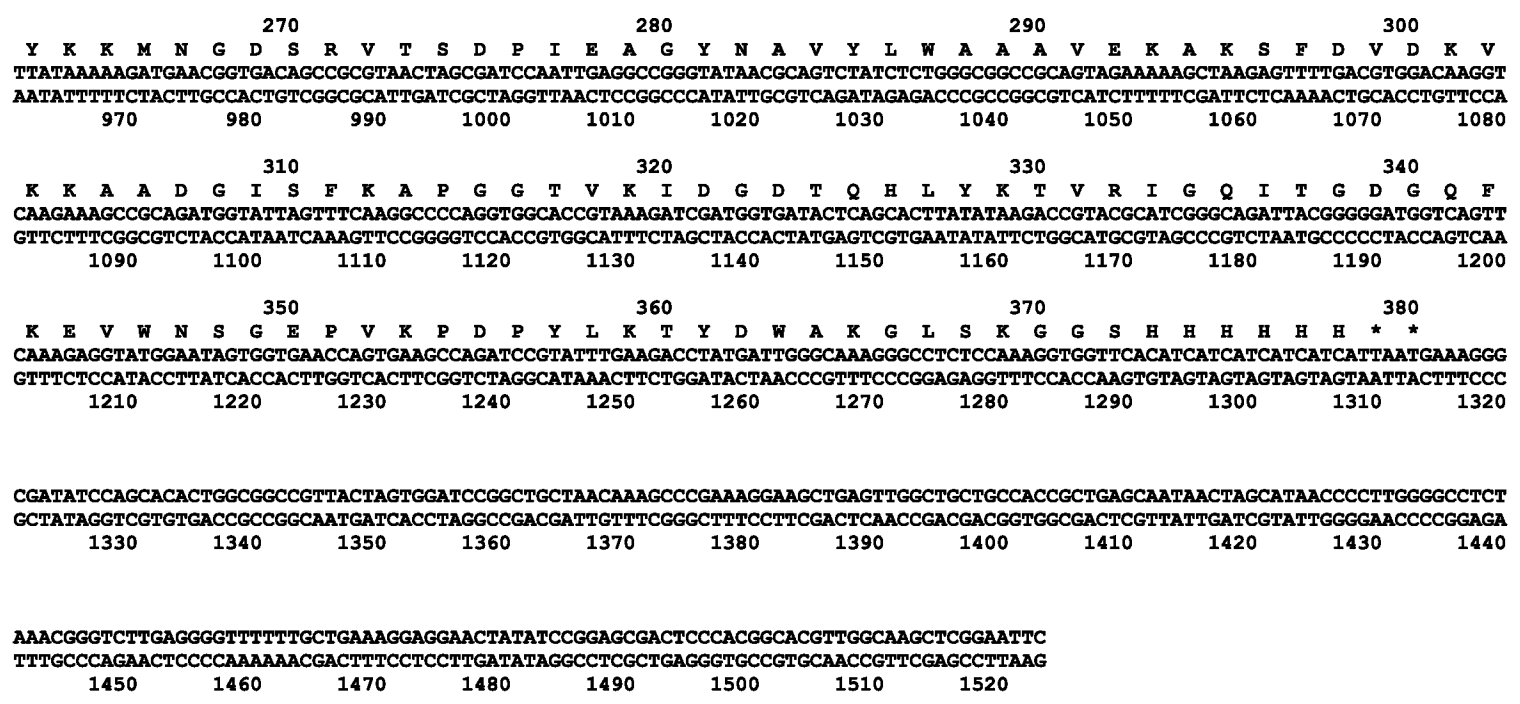

FIG. 49 shows the sequence of an exemplary bsUBP3_77C expression construct (SEQ ID NO: 141).

FIG. 50 shows the sequence of an exemplary bsUBP3_78C expression construct (SEQ ID NO: 142).

FIG. 51 shows the sequence of an exemplary bsUBP3_79C expression construct (SEQ ID NO: 143).

Figure 52:
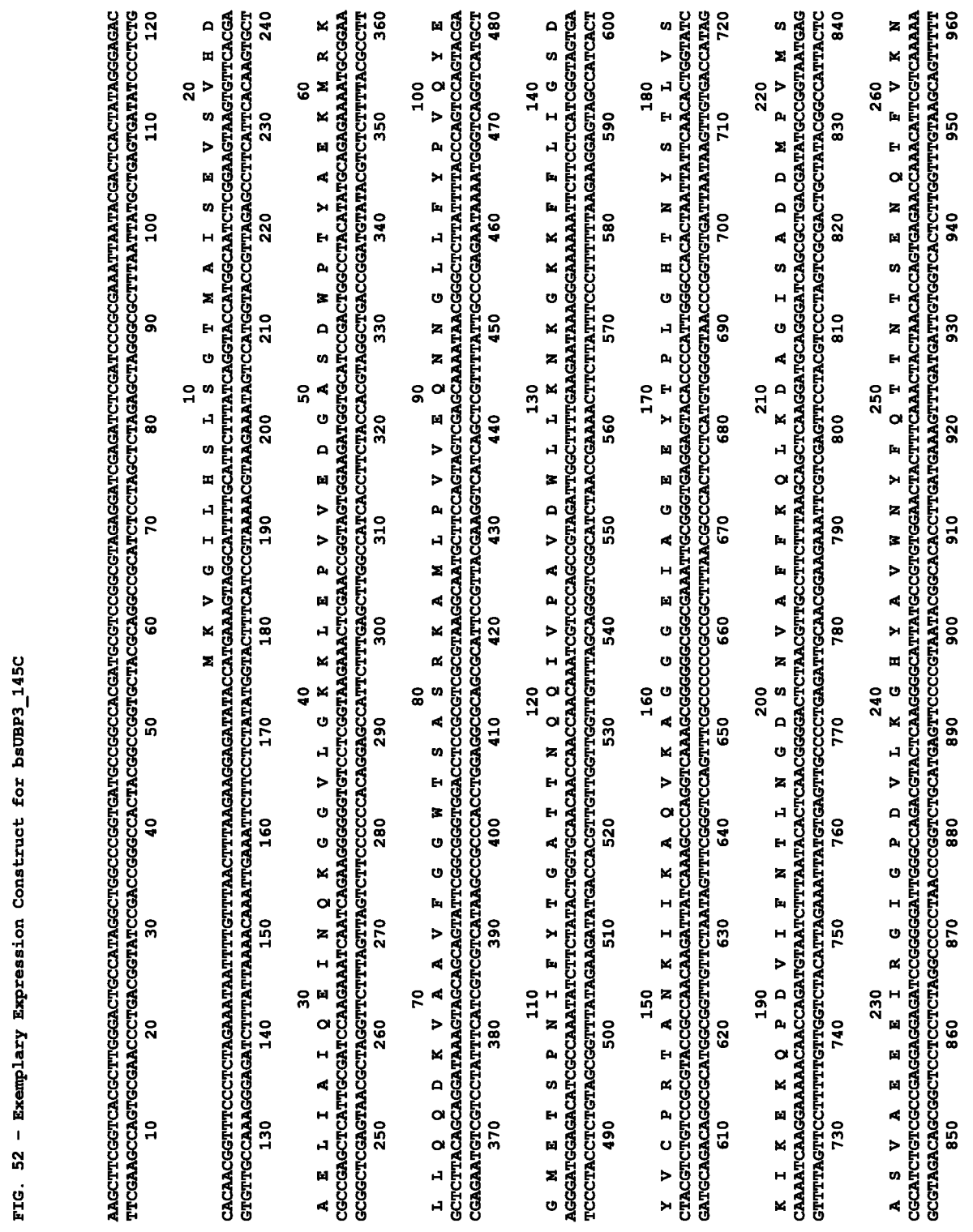

FIG. 52 shows the sequence of an exemplary bsUBP3_145C expression construct (SEQ ID NO: 144).

Figure 53:
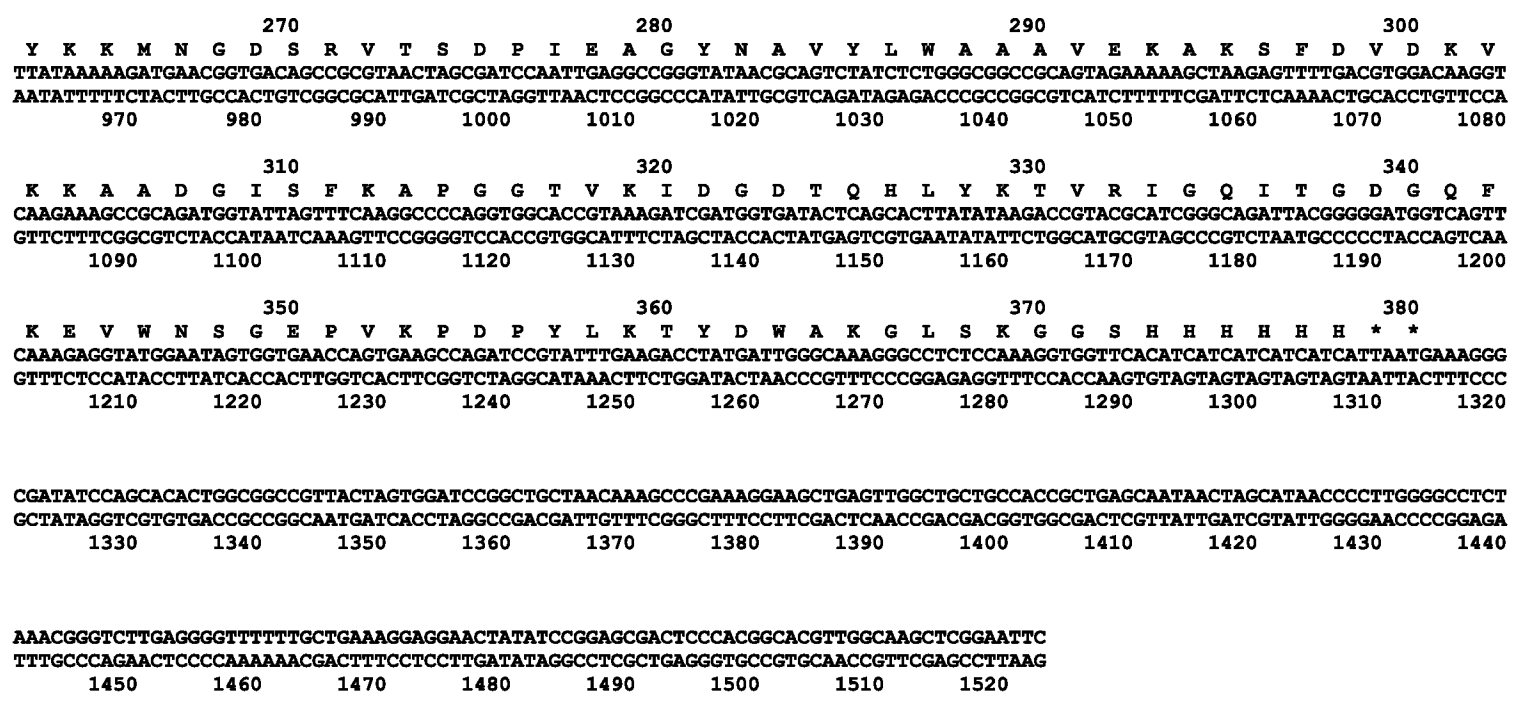

FIG. 53 shows the sequence of an exemplary bsUBP3_172C expression construct (SEQ ID NO: 145).

Figure 54:
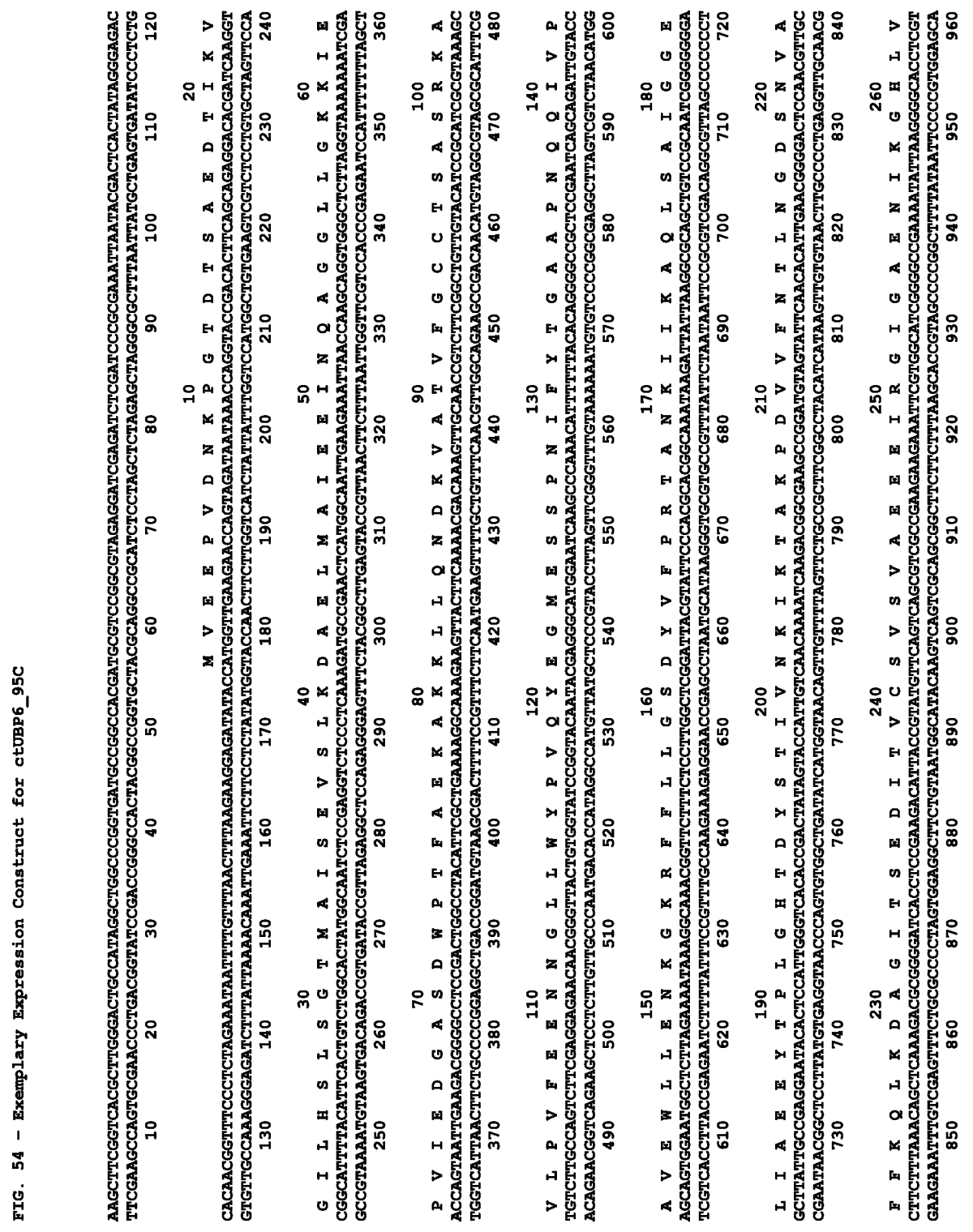

FIG. 54 shows the sequence of an exemplary ctUBP6_95C expression construct (SEQ ID NO: 146).

FIG. 55 shows the sequence of an exemplary ctUBP6_96C expression construct (SEQ ID NO: 147).

FIG. 56 shows the sequence of an exemplary ctUBP6_97C expression construct (SEQ ID NO: 148).

Figure 57:
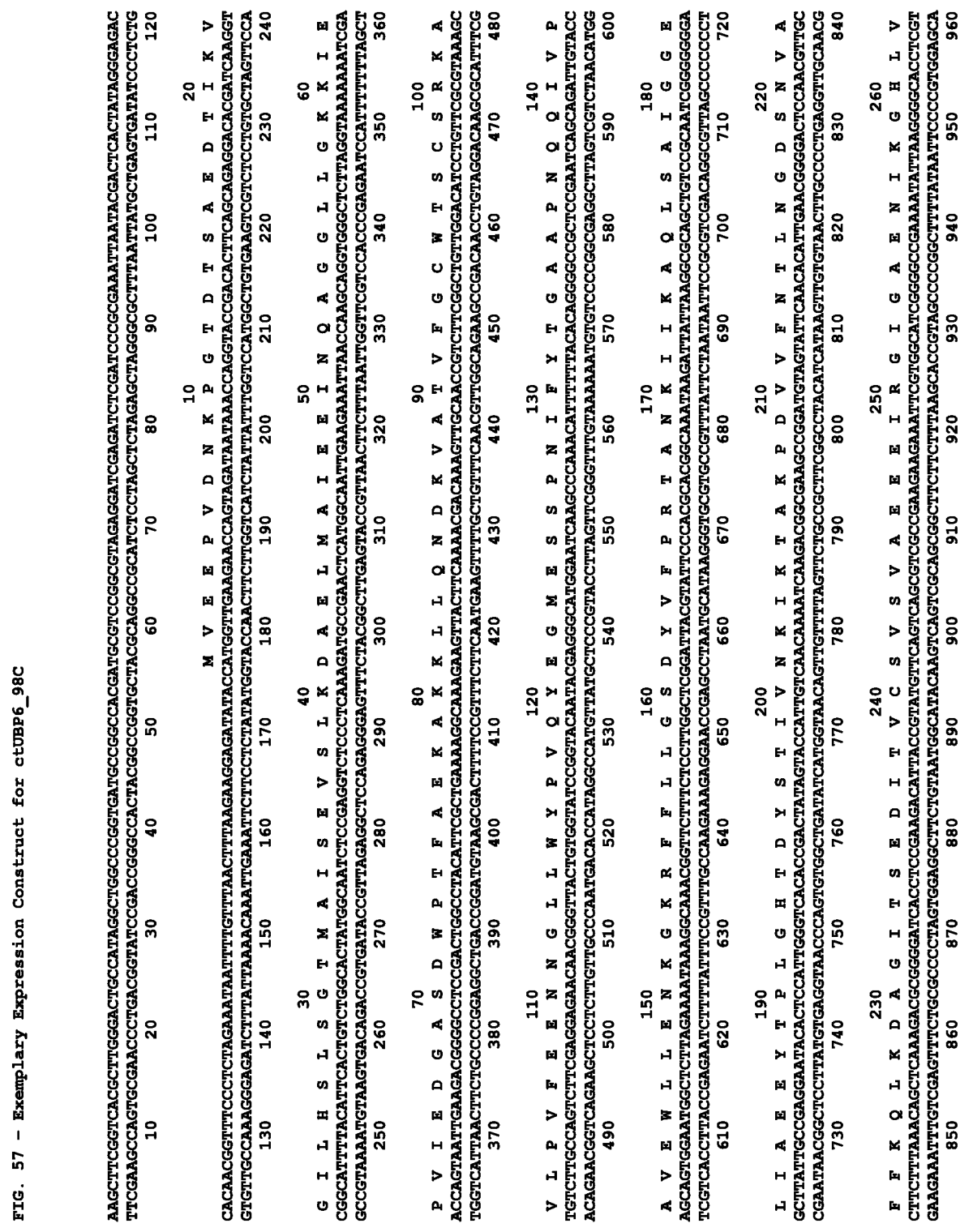

FIG. 57 shows the sequence of an exemplary ctUBP6_98C expression construct (SEQ ID NO: 149).

Figure 58:
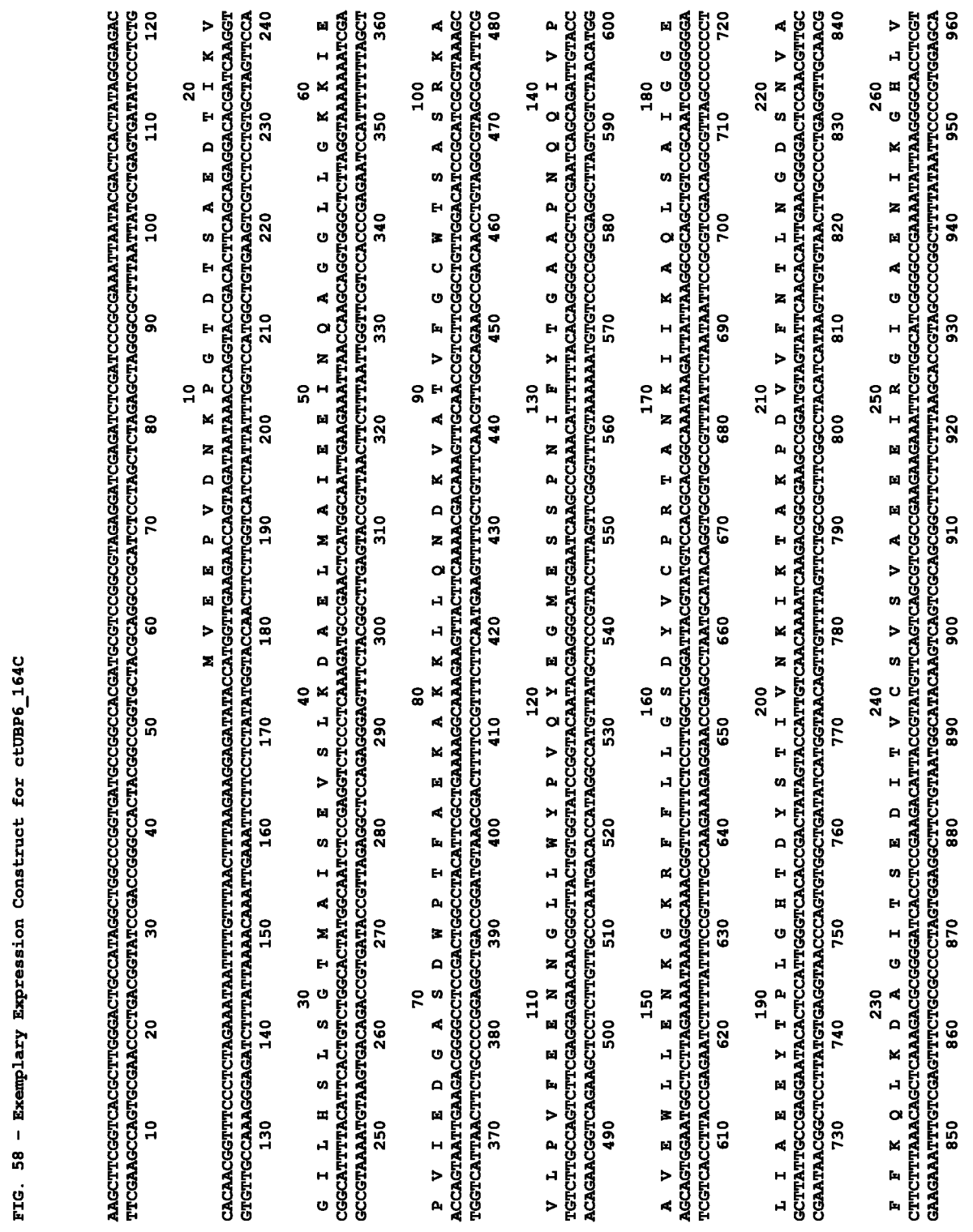

FIG. 58 shows the sequence of an exemplary ctUBP6_164C expression construct (SEQ ID NO: 150).

FIG. 59 shows the sequence of an exemplary ctUBP6_191C expression construct (SEQ ID NO: 151).

FIG. 60 shows the sequence of an exemplary csUBP7_186C.1 expression construct (SEQ ID NO: 152).

FIG. 61 shows the sequence of an exemplary csUBP7_186C.2 expression construct (SEQ ID NO: 153).

FIG. 62 shows the sequence of an exemplary csUBP7_186C.3 expression construct (SEQ ID NO: 154).

FIG. 63 shows the sequence of an exemplary csUBP7_186C.4 expression construct (SEQ ID NO: 155).

Figure 64:
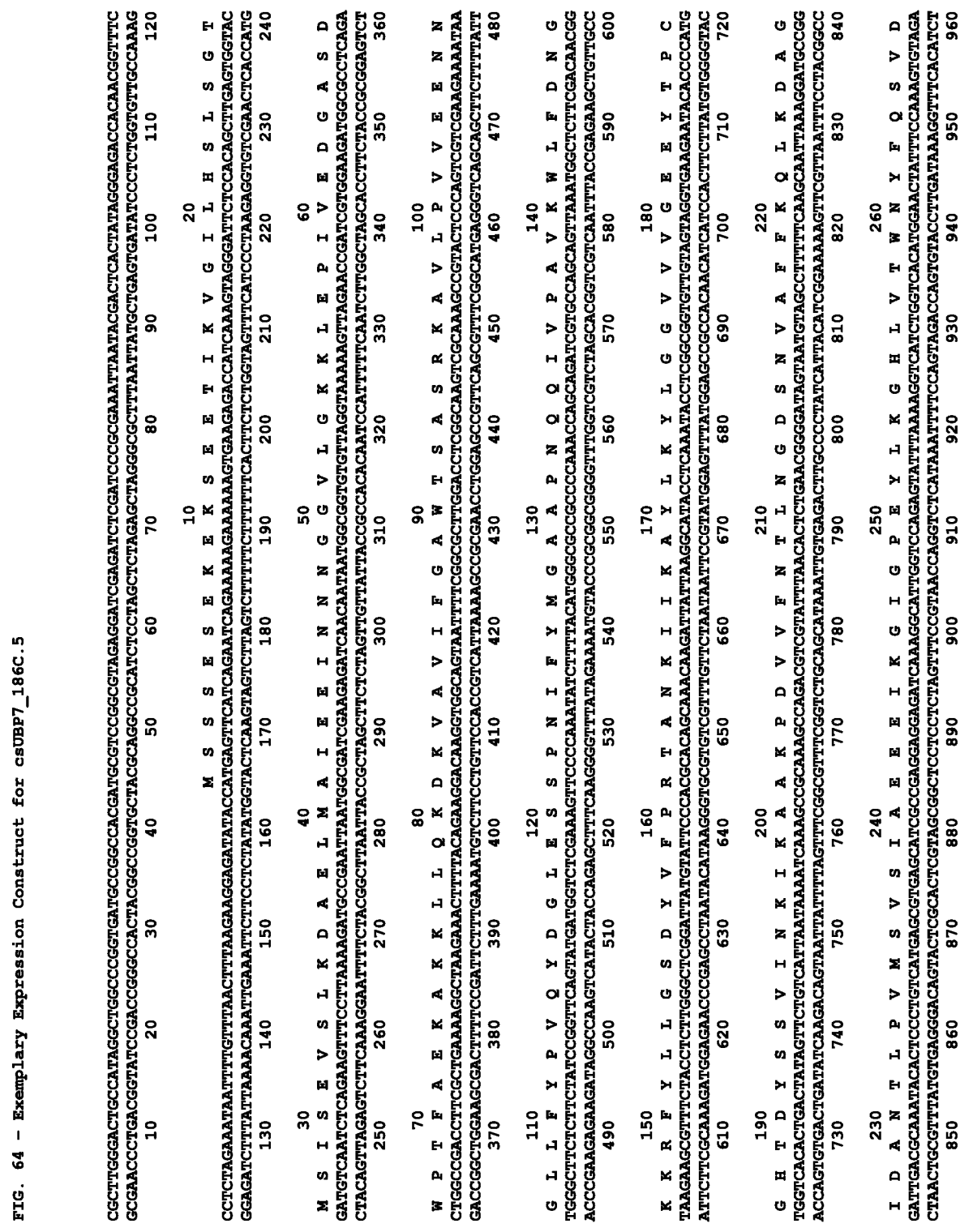

FIG. 64 shows the sequence of an exemplary csUBP7_186C.5 expression construct (SEQ ID NO: 156).

Figure 65:
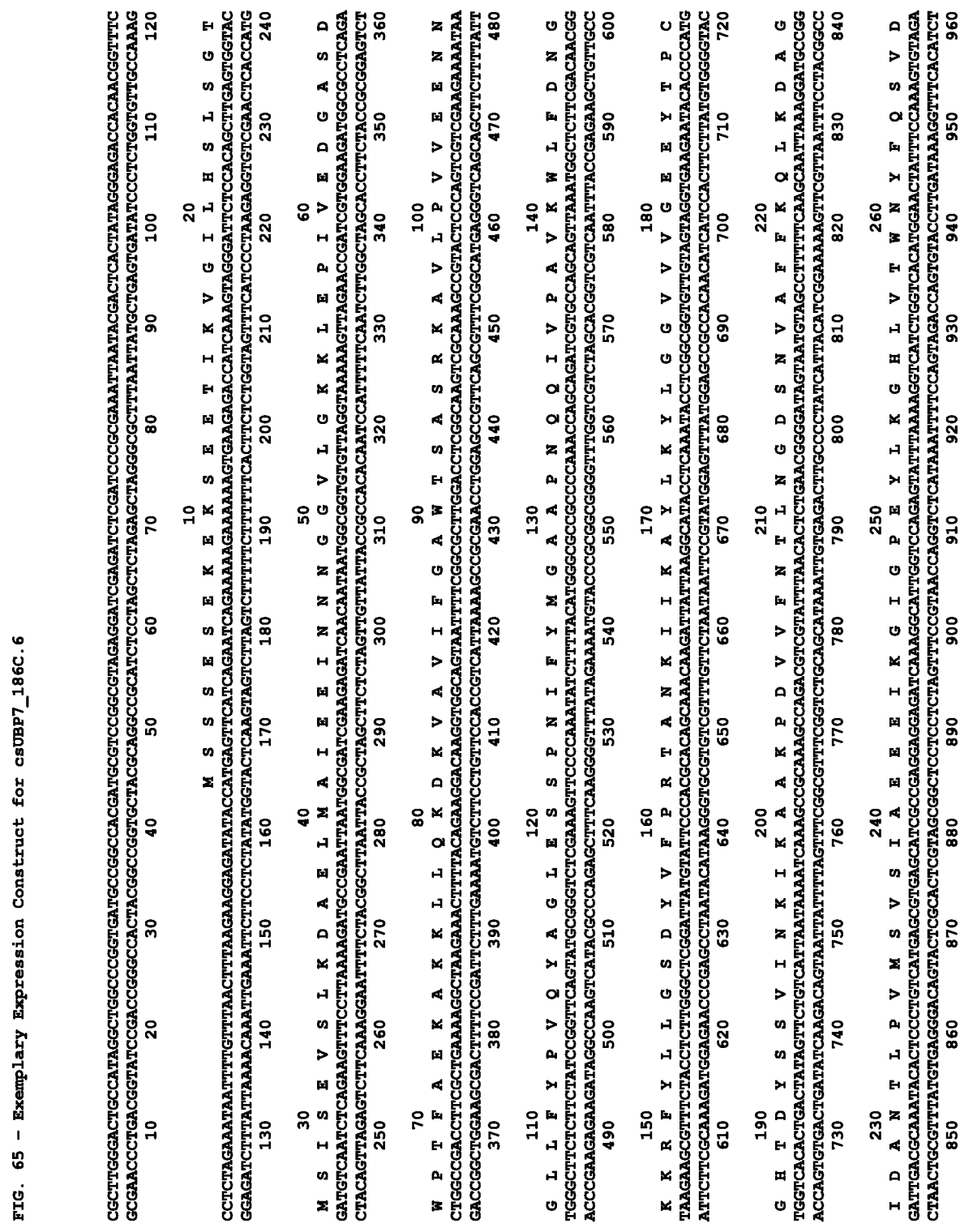

FIG. 65 shows the sequence of an exemplary csUBP7_186C.6 expression construct (SEQ ID NO: 157).

FIG. 66 shows the sequence of an exemplary csUBP7_186C.7 expression construct (SEQ ID NO: 158).

FIG. 67 shows the sequence of an exemplary csUBP7_186C.8 expression construct (SEQ ID NO: 159).

FIG. 68 shows the sequence of an exemplary csUBP7_186C.9 expression construct (SEQ ID NO: 160).

FIG. 69 shows the sequence of an exemplary csUBP7_186C.10 expression construct (SEQ ID NO: 161).

FIG. 70 shows the sequence of an exemplary csUBP7_186C.11 expression construct (SEQ ID NO: 162).

Figure 71:
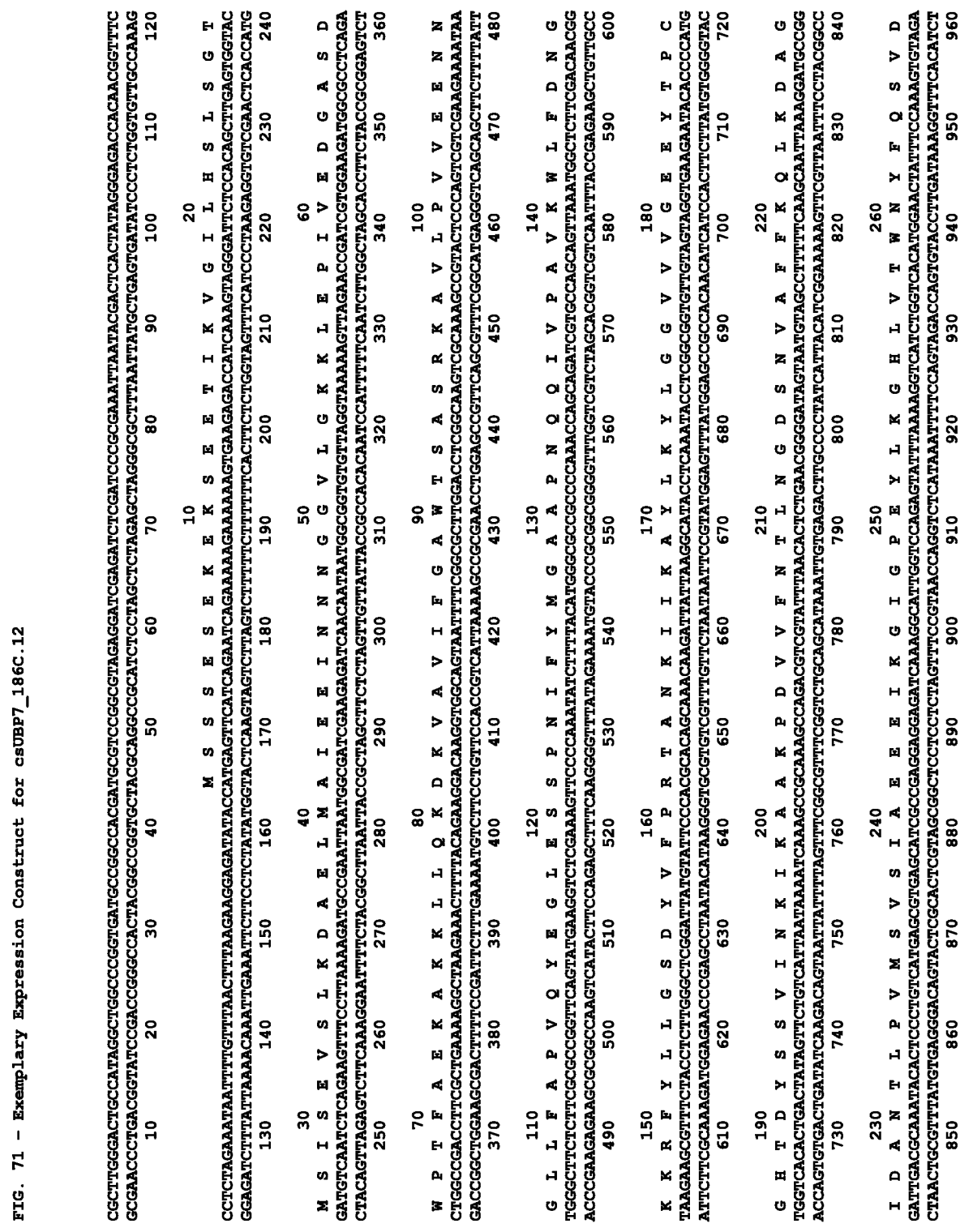

FIG. 71 shows the sequence of an exemplary csUBP7_186C.12 expression construct (SEQ ID NO: 163).

FIG. 72 shows the sequence of an exemplary csUBP7_186C.13 expression construct (SEQ ID NO: 164).

FIG. 73 shows the sequence of an exemplary csUBP7_186C.14 expression construct (SEQ ID NO: 165).

FIG. 74 shows the sequence of an exemplary csUBP7_186C.15 expression construct (SEQ ID NO: 166).

Figure 75:
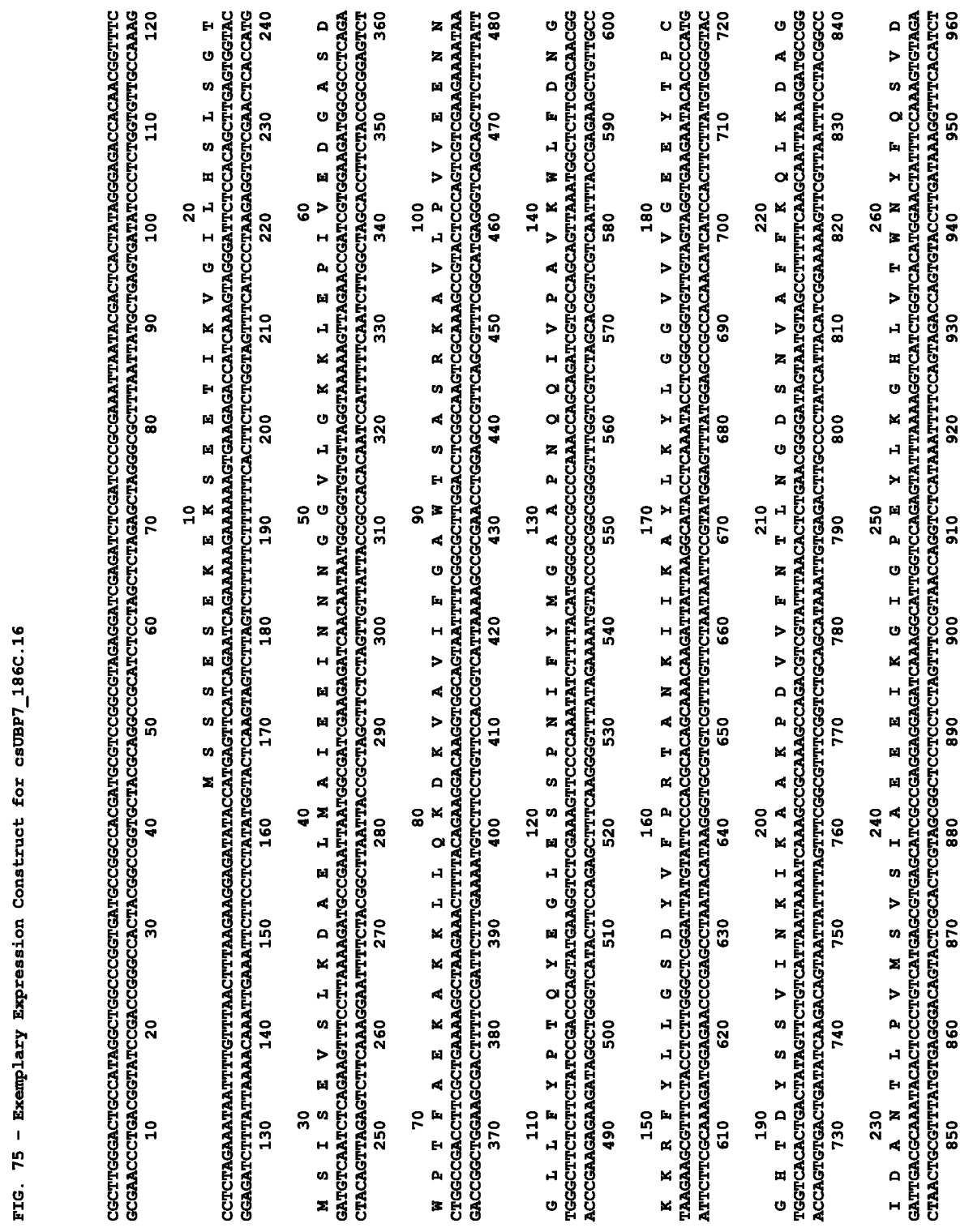

FIG. 75 shows the sequence of an exemplary csUBP7_186C.16 expression construct (SEQ ID NO: 167).

Figure 76:
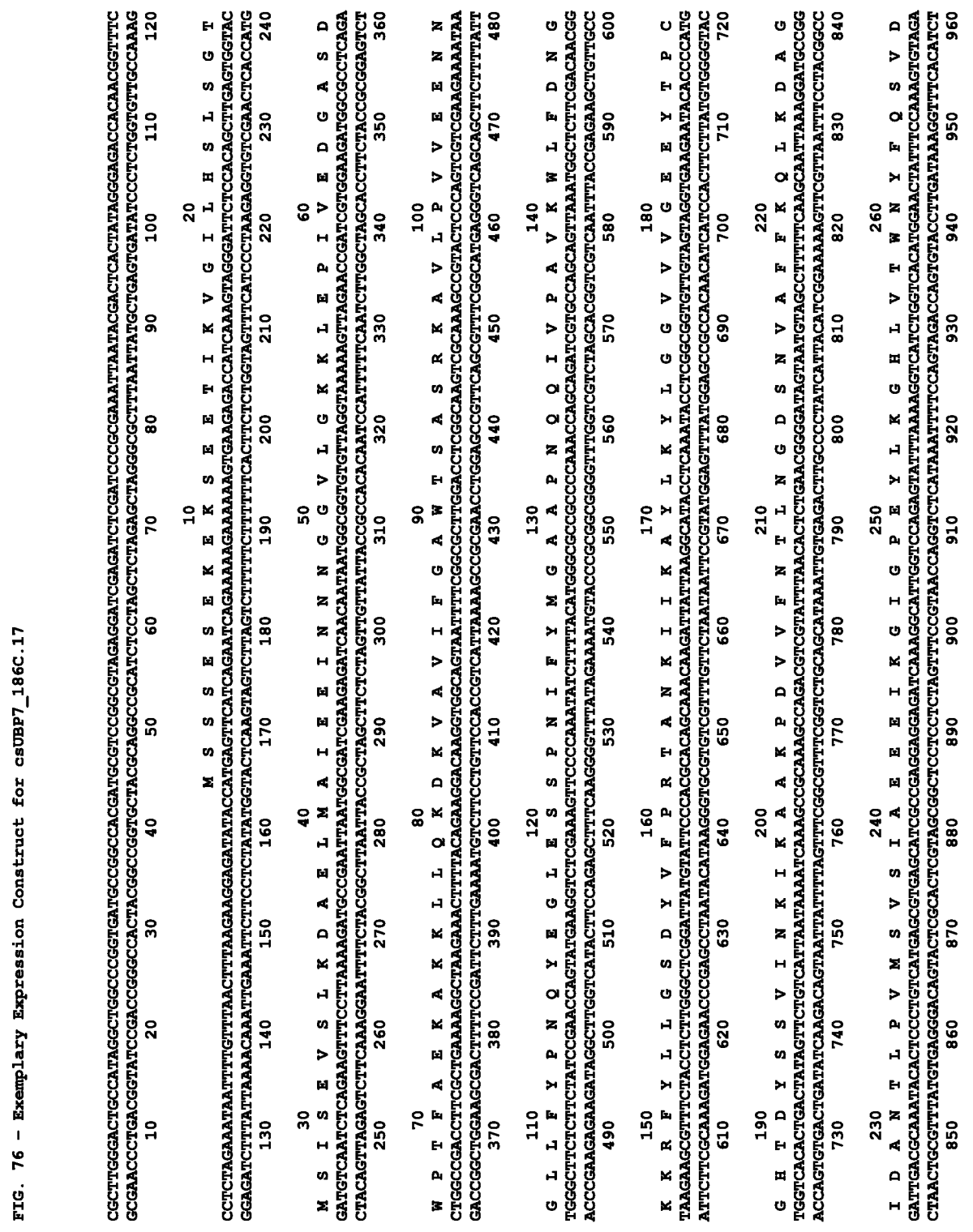

FIG. 76 shows the sequence of an exemplary csUBP7_186C.17 expression construct (SEQ ID NO: 168).

FIG. 77 shows the sequence of an exemplary csUBP7_186C.18 expression construct (SEQ ID NO: 169).

Figure 78:
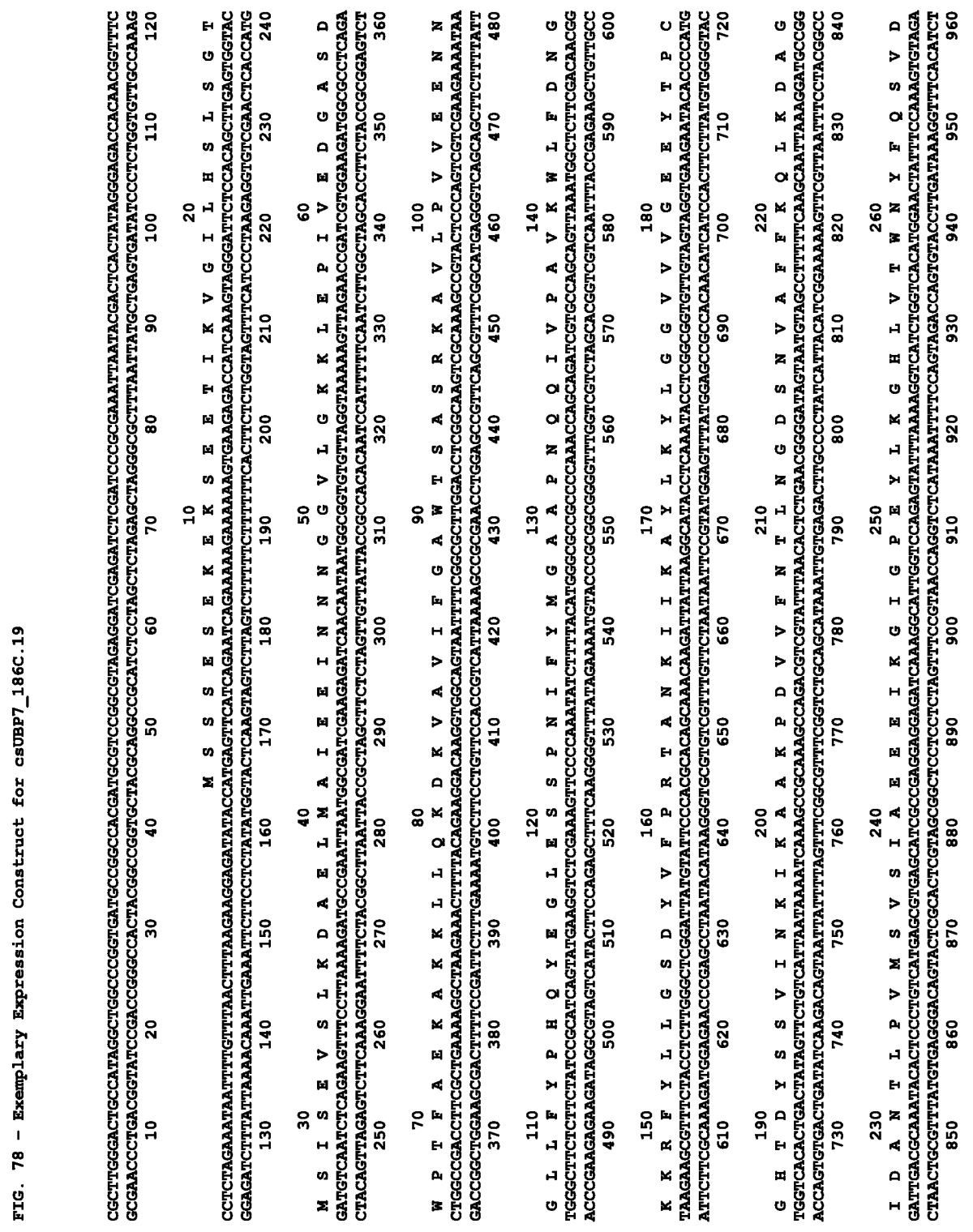

FIG. 78 shows the sequence of an exemplary csUBP7_186C.19 expression construct (SEQ ID NO: 170).

Figure 79:
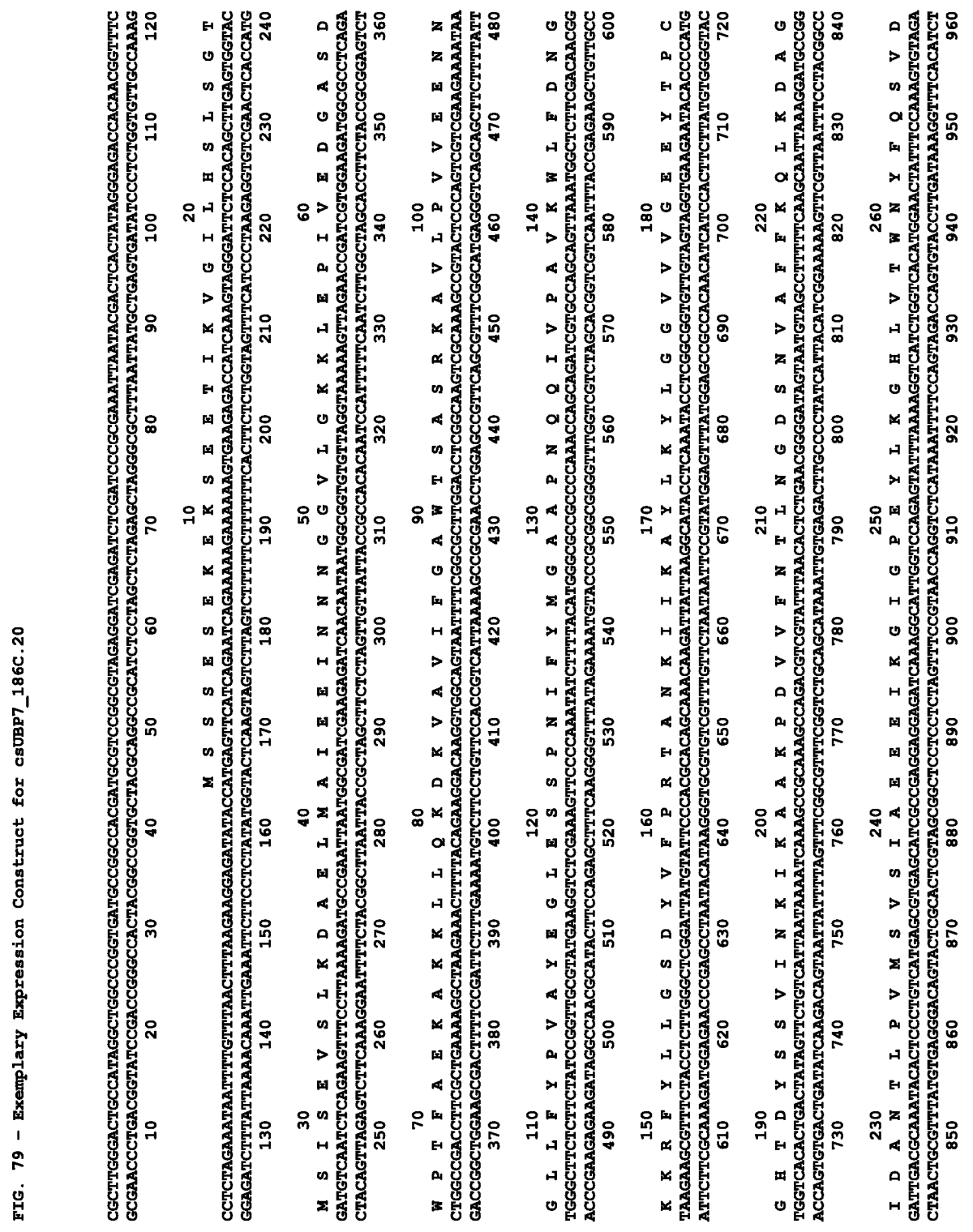

FIG. 79 shows the sequence of an exemplary csUBP7_186C.20 expression construct (SEQ ID NO: 171).

Figure 80:
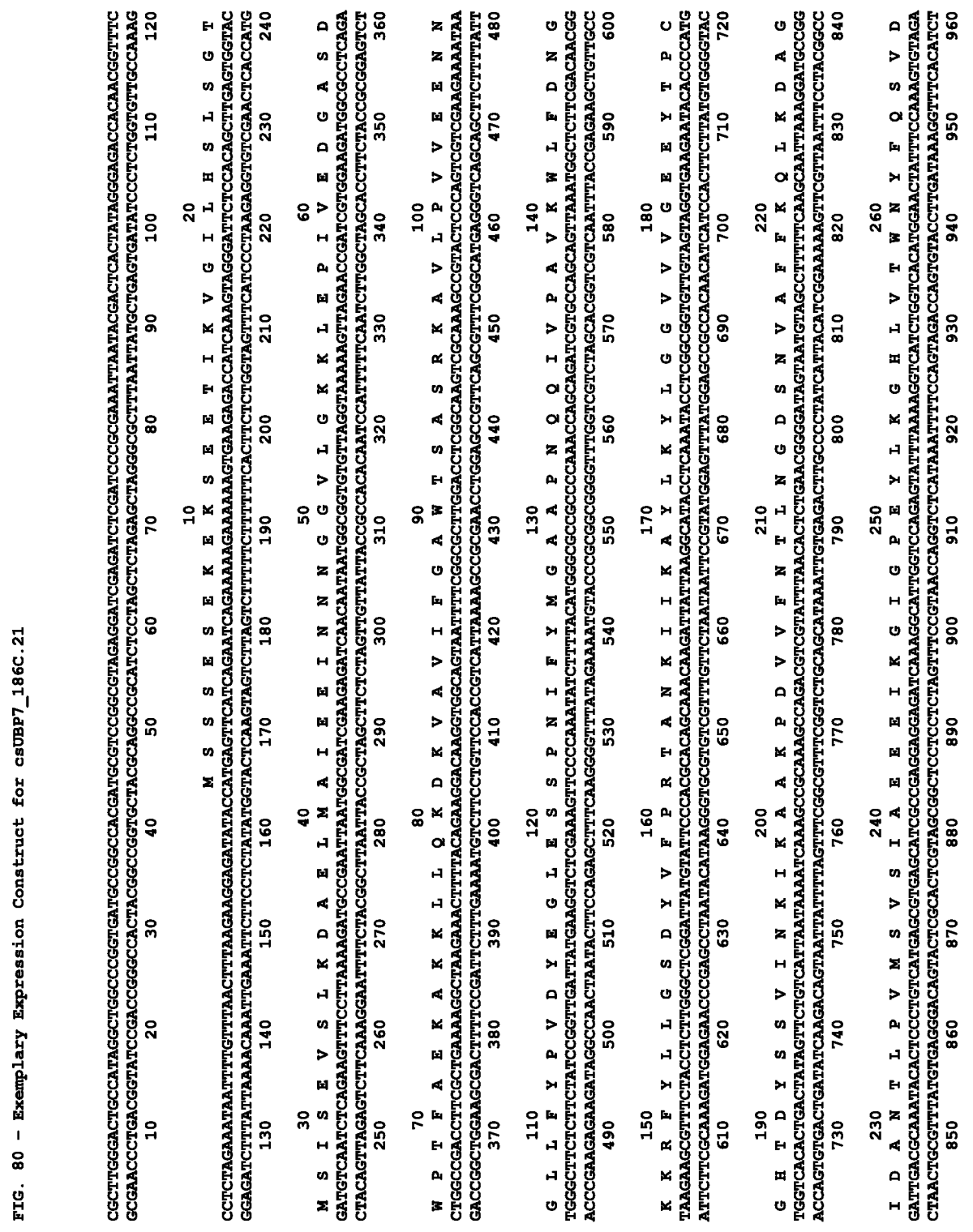

FIG. 80 shows the sequence of an exemplary csUBP7_186C.21 expression construct (SEQ ID NO: 172).

FIG. 81 shows the sequence of an exemplary csUBP7_186C.22 expression construct (SEQ ID NO: 173).

FIG. 82 shows the sequence of an exemplary csUBP7_186C.23 expression construct (SEQ ID NO: 174).

FIG. 83 shows the sequence of an exemplary csUBP7_186C.24 expression construct (SEQ ID NO: 175).

Figure 84:
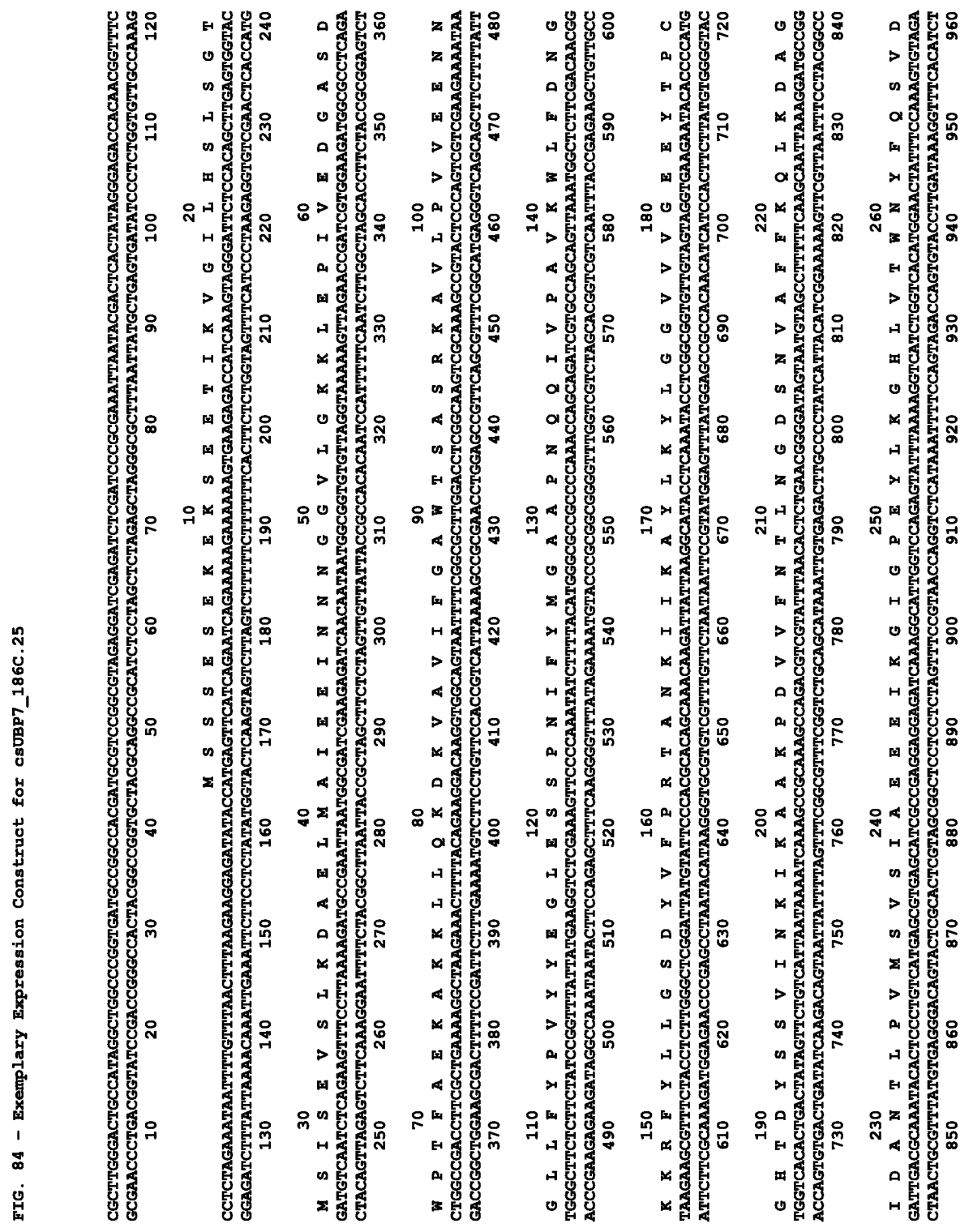

FIG. 84 shows the sequence of an exemplary csUBP7_186C.25 expression construct (SEQ ID NO: 176).

Figure 85:
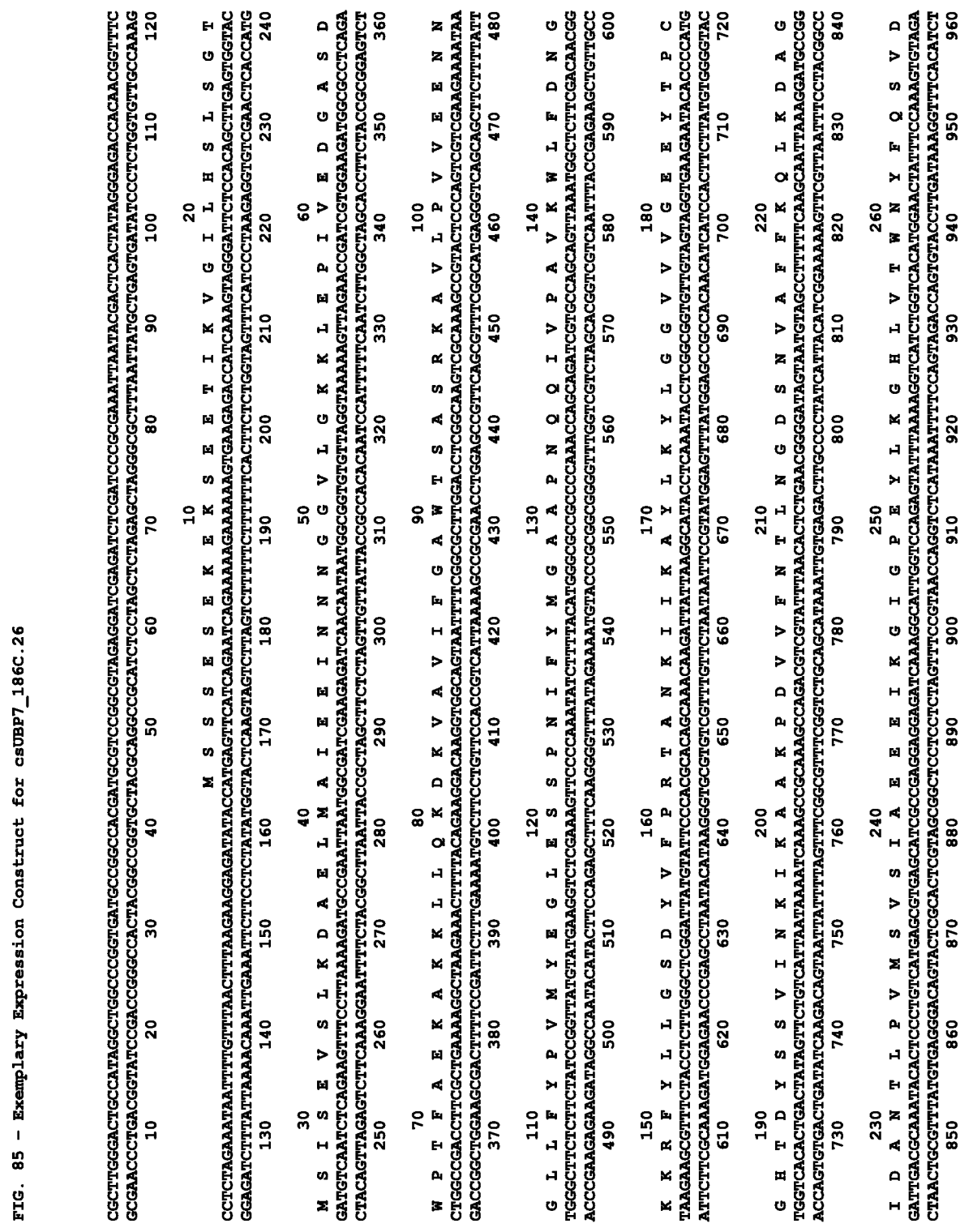

FIG. 85 shows the sequence of an exemplary csUBP7_186C.26 expression construct (SEQ ID NO: 177).

FIG. 86 shows the sequence of an exemplary csUBP7_186C.27 expression construct (SEQ ID NO: 178).

FIG. 87 shows the sequence of an exemplary csUBP7_186C.28 expression construct (SEQ ID NO: 179).

FIG. 88 shows the sequence of an exemplary csUBP7_186C.29 expression construct (SEQ ID NO: 180).

FIG. 89 shows the sequence of an exemplary csUBP7_186C.30 expression construct (SEQ ID NO: 181).

Figure 90:
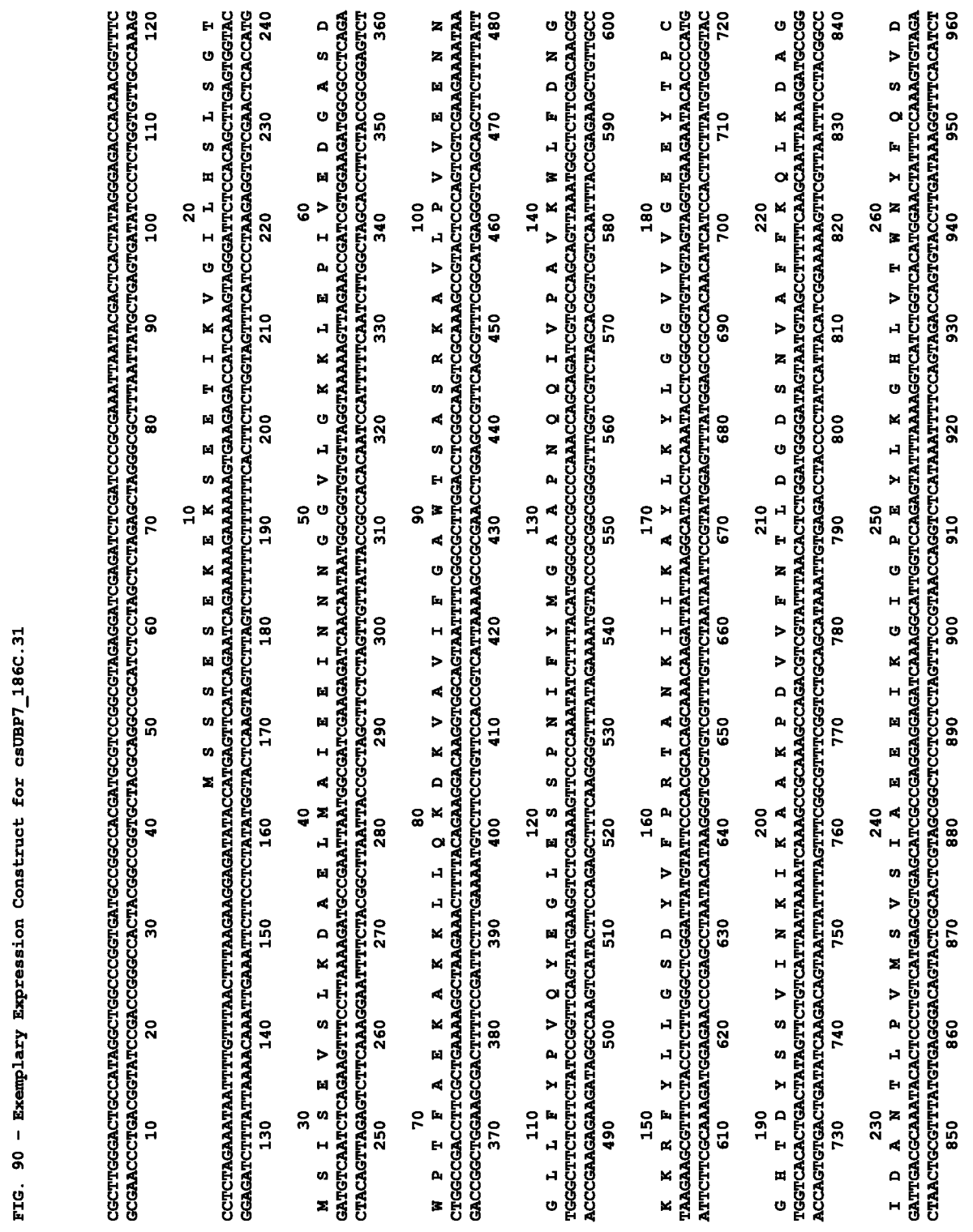

FIG. 90 shows the sequence of an exemplary csUBP7_186C.31 expression construct (SEQ ID NO: 182).

Figure 91:
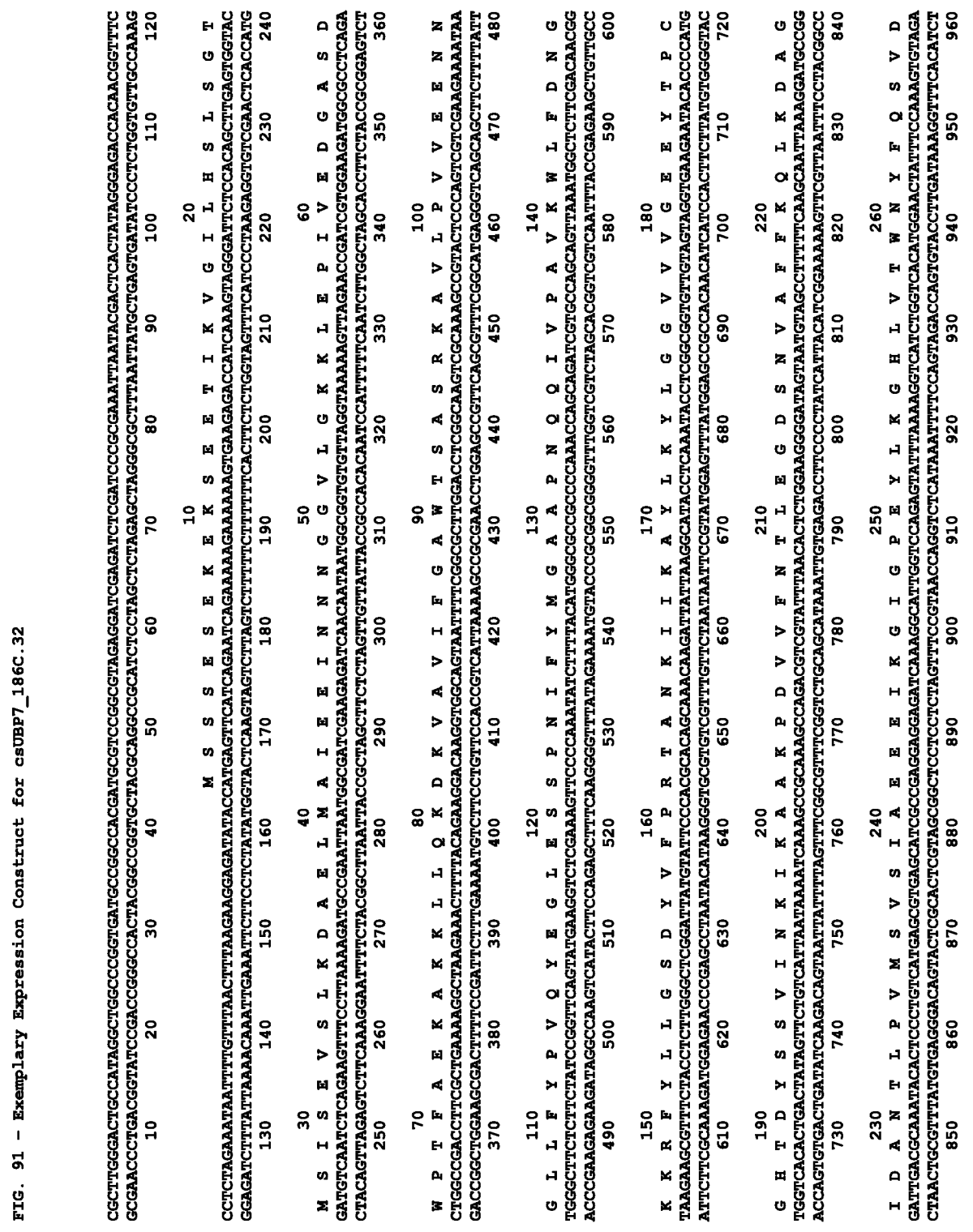

FIG. 91 shows the sequence of an exemplary csUBP7_186C.32 expression construct (SEQ ID NO: 183).

FIG. 92 shows the sequence of an exemplary csUBP7_186C.33 expression construct (SEQ ID NO: 184).

FIG. 93 shows the sequence of an exemplary csUBP7_186C.34 expression construct (SEQ ID NO: 185).

Figure 94:
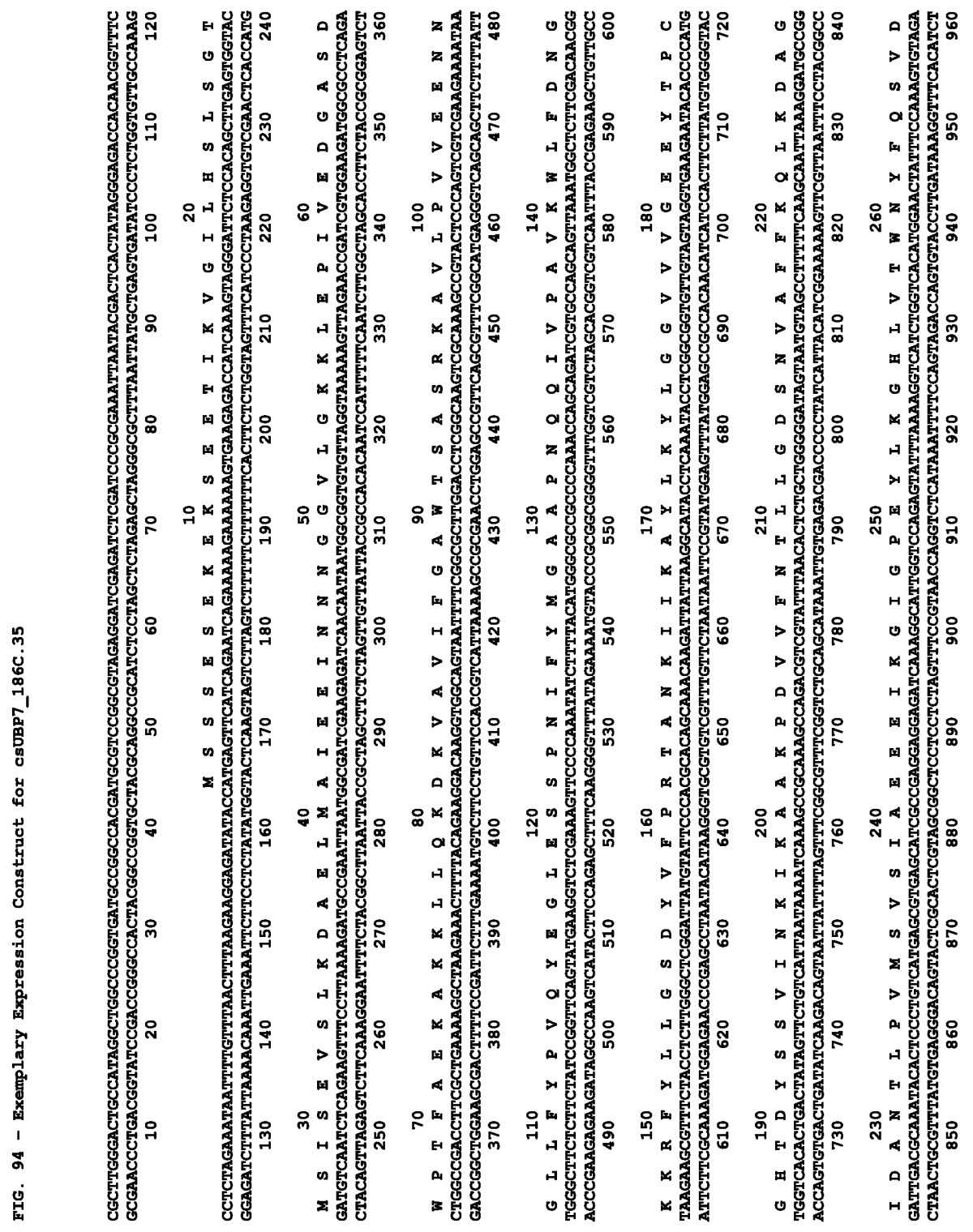

FIG. 94 shows the sequence of an exemplary csUBP7_186C.35 expression construct (SEQ ID NO: 186).

FIG. 95 shows the sequence of an exemplary csUBP7_186C.36 expression construct (SEQ ID NO: 187).

FIG. 96 shows the sequence of an exemplary csUBP7_186C.37 expression construct (SEQ ID NO: 188).

Figure 97:
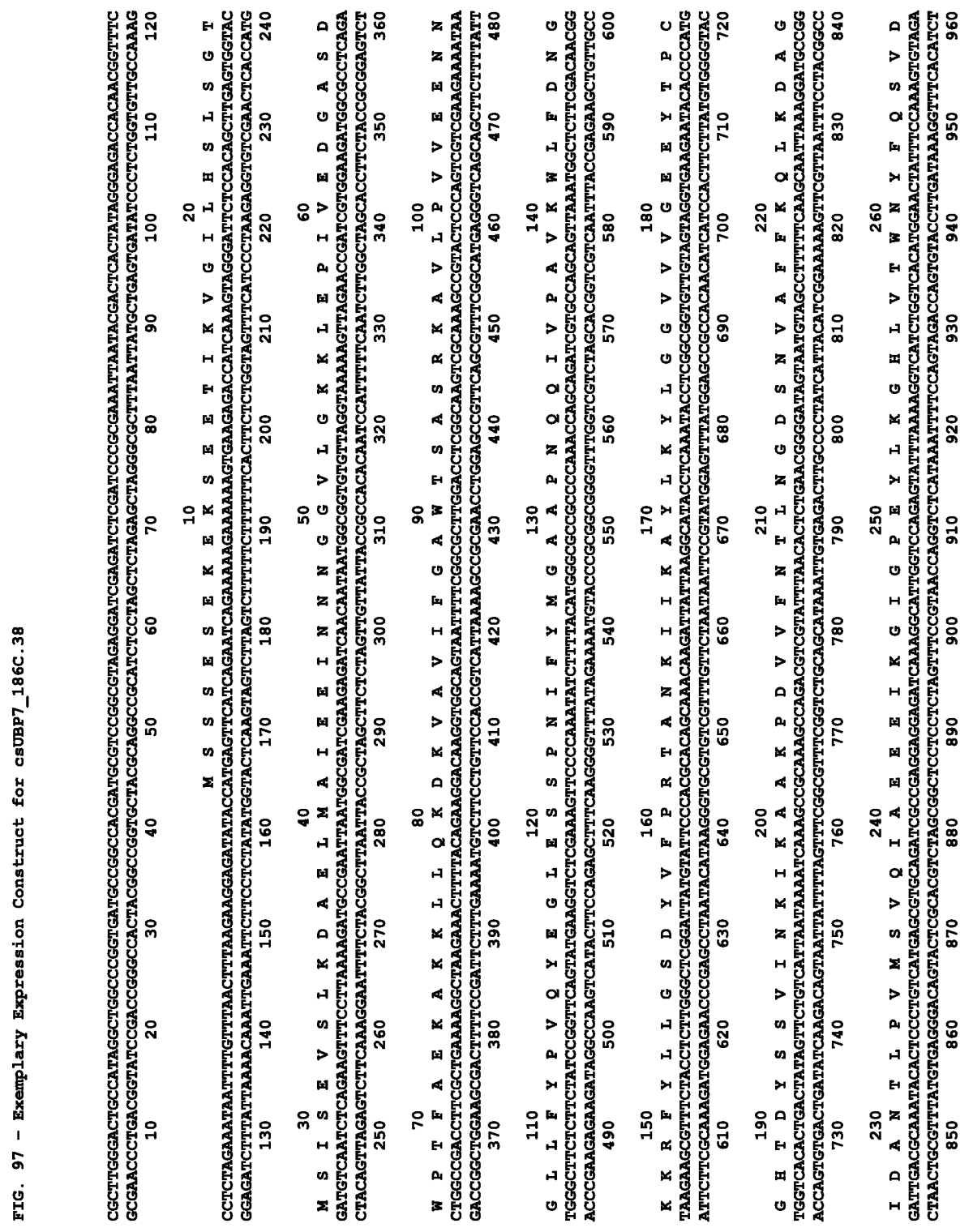

FIG. 97 shows the sequence of an exemplary csUBP7_186C.38 expression construct (SEQ ID NO: 189).

FIG. 98 shows the sequence of an exemplary csUBP7_186C.39 expression construct (SEQ ID NO: 190).

Figure 99:
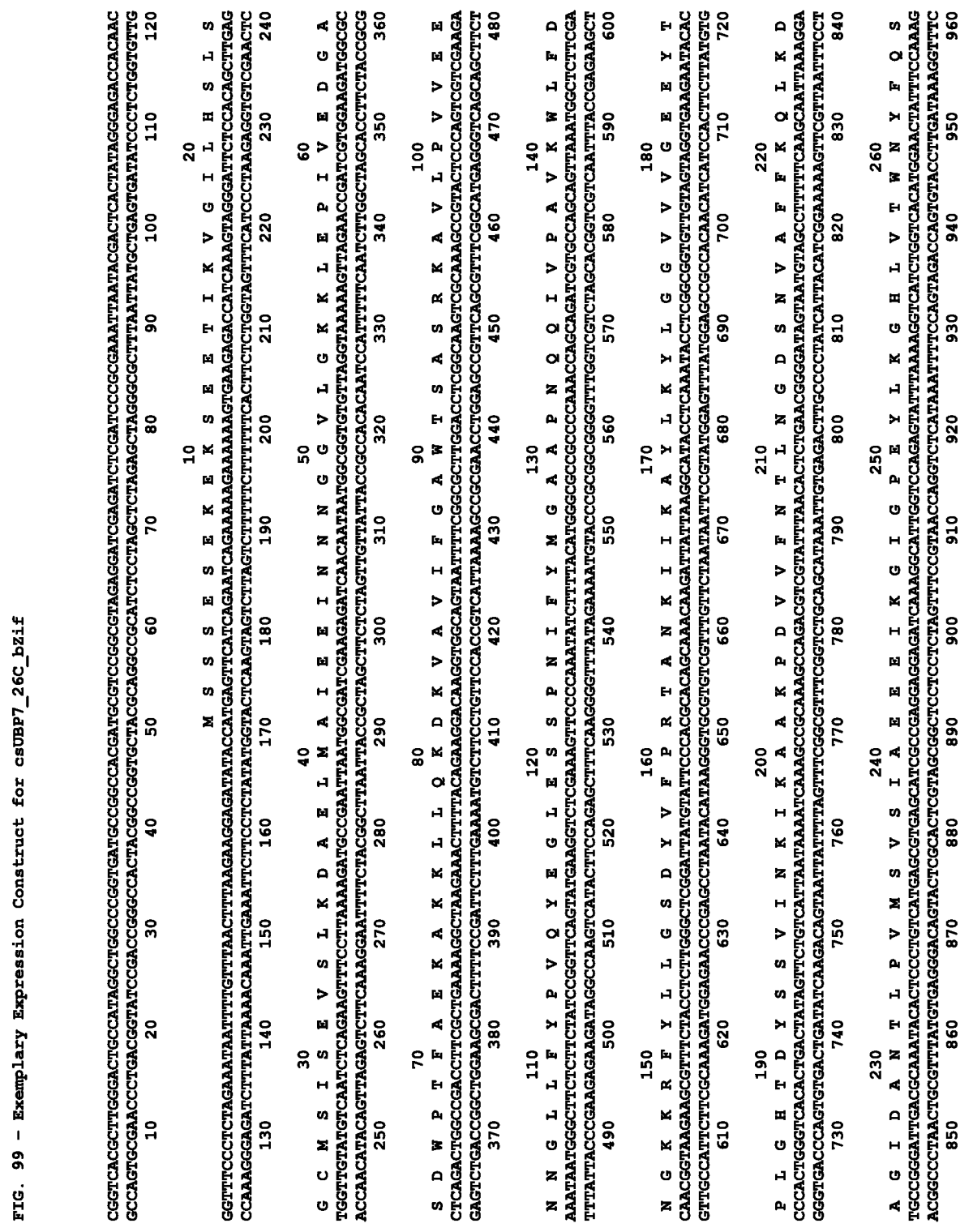

FIG. 99 shows the sequence of an exemplary csUBP7_26C_bZif expression construct (SEQ ID NO: 191).

Figure 100:
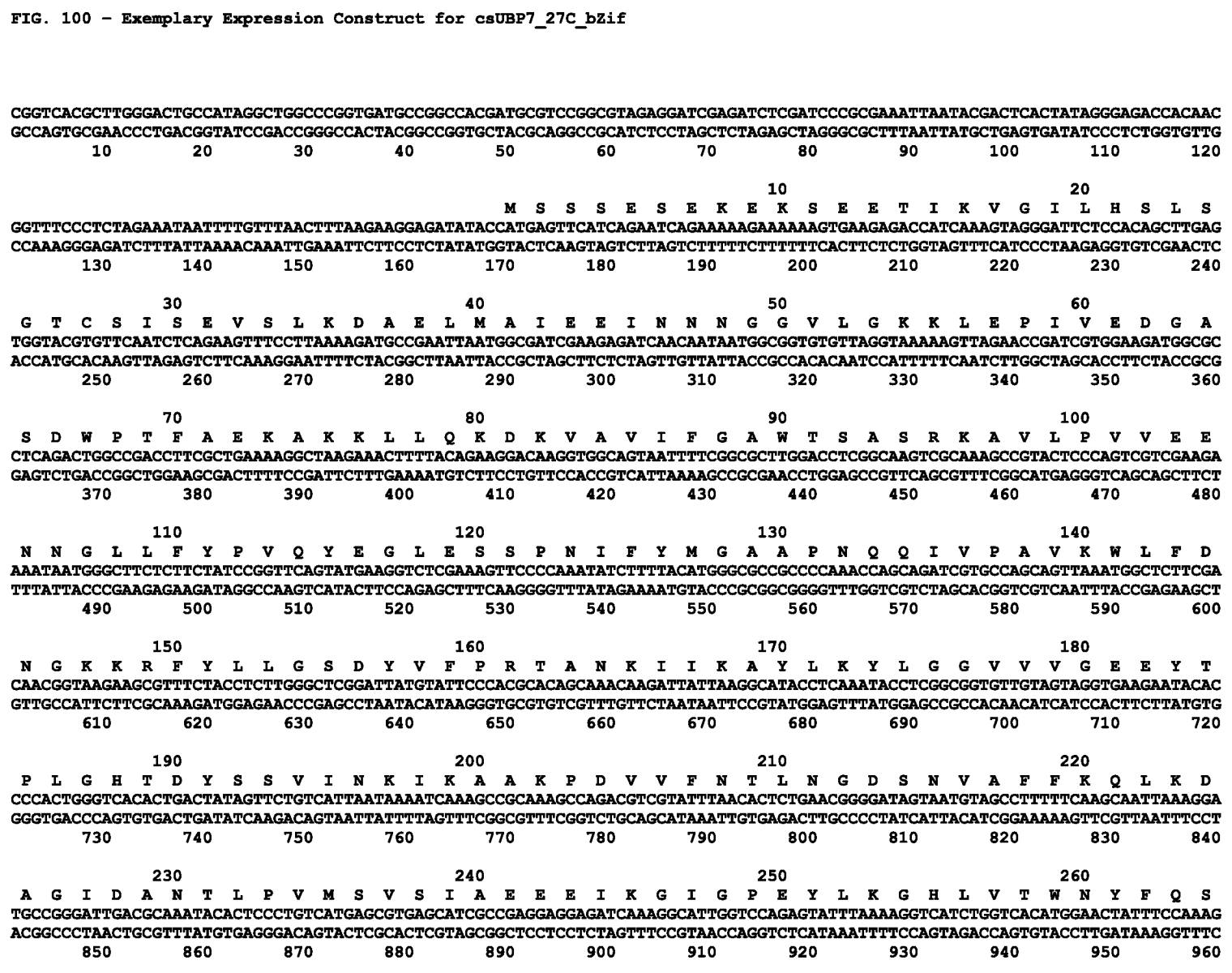

FIG. 100 shows the sequence of an exemplary csUBP7_27C_bZif expression construct (SEQ ID NO: 192).

FIG. 101 shows the sequence of an exemplary csUBP7_30C_bZif expression construct (SEQ ID NO: 193).

FIG. 102 shows the sequence of an exemplary csUBP7_95C_bZif expression construct (SEQ ID NO: 194).

FIG. 103 shows the sequence of an exemplary csUBP7_186C.20_bZif expression construct (SEQ ID NO: 195).

FIG. 104 shows the sequence of an exemplary csUBP7_186C.114A_Imm1 expression construct (SEQ ID NO: 196).

FIG. 105 shows the sequence of an exemplary csUBP7_186C.114A_Imm2 expression construct (SEQ ID NO: 197).

FIG. 106 shows the sequence of an exemplary csUBP7_186C.114A_Imm3 expression construct (SEQ ID NO: 198).

FIG. 107 shows the sequence of an exemplary csUBP7_186C.114A_Imm4 expression construct (SEQ ID NO: 199).

FIG. 108 shows the sequence of an exemplary csUBP7_186C.114A_Imm5 expression construct (SEQ ID NO: 200).

Figure 109:
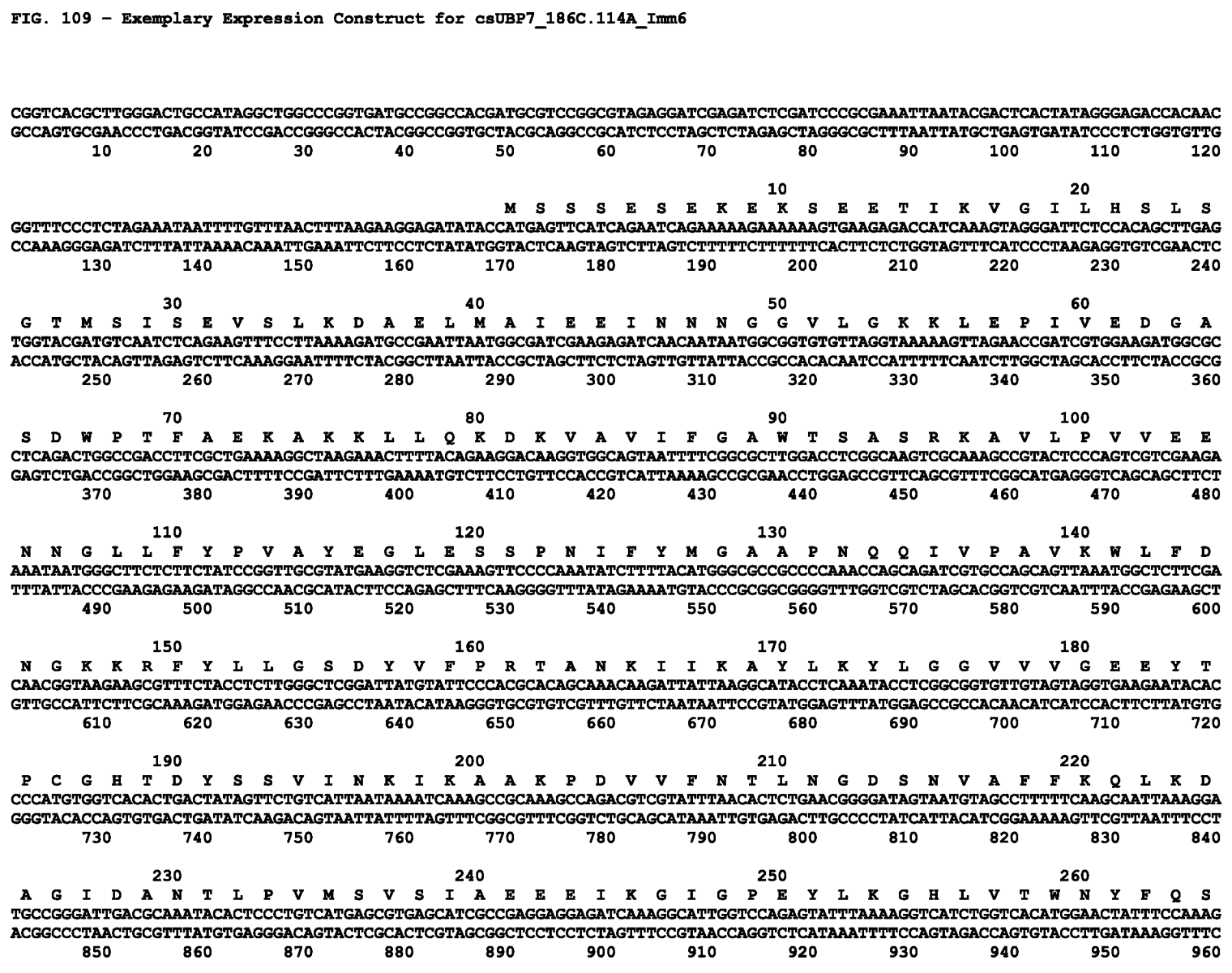

FIG. 109 shows the sequence of an exemplary csUBP7_186C.114A_Imm6 expression construct (SEQ ID NO: 201).

FIG. 110 is a diagram relating to directly responsive partners and indirectly responsive partners in ngmFRET pathways.

DETAILED DESCRIPTION

Figure 1A:
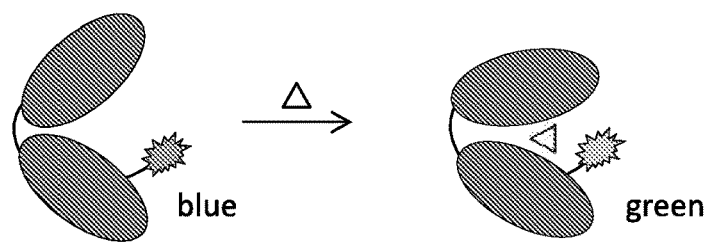
FIG. 1A is a cartoon and FIGS. 1B-D are graphs illustrating fluorescently responsive sensors.
Figure 1B:
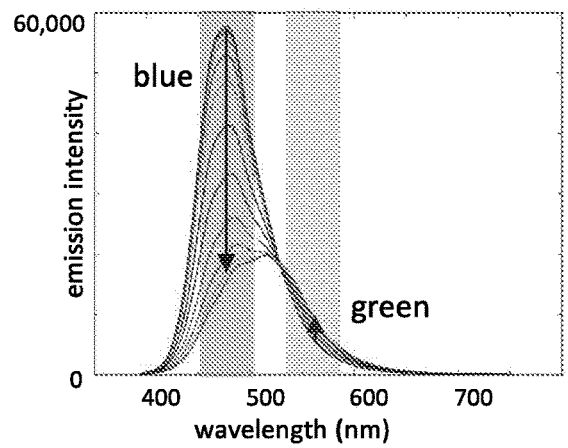
Figure 1C:
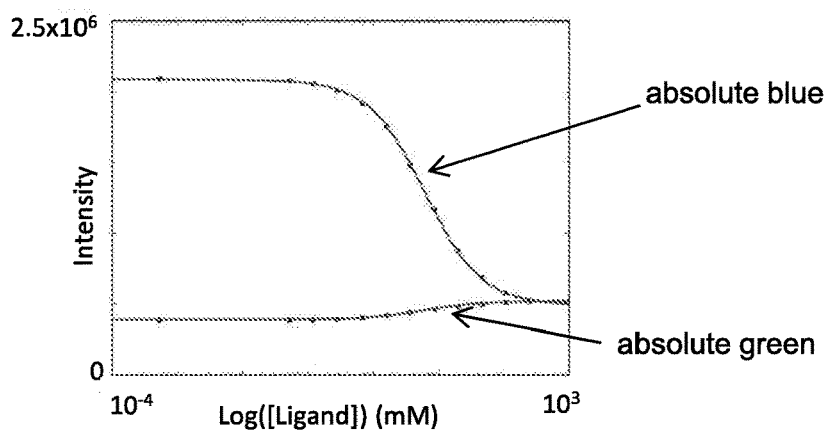
Figure 1D:
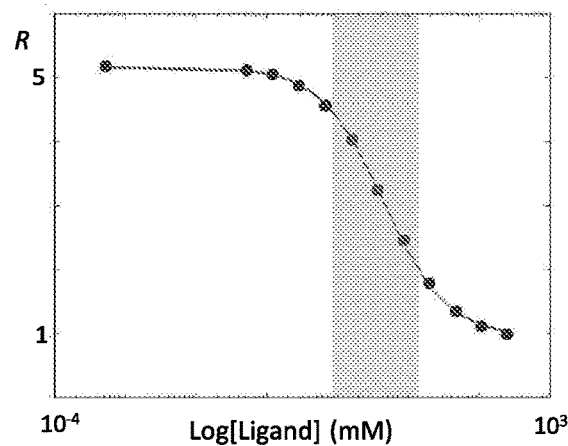
Figure 2A:
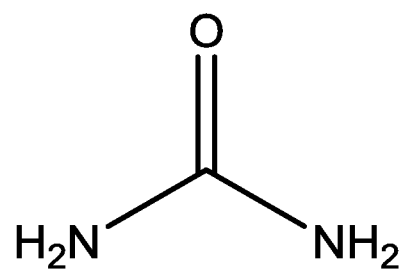
FIGS. 2A and B show the structures of area (FIG. 2A) and acetamide (FIG. 2B).
Figure 2B:
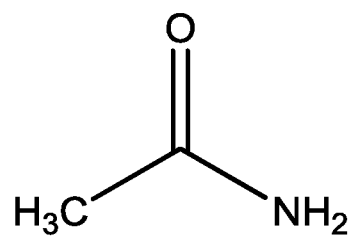

Urea plays a significant role in the global nitrogen cycle, functioning both as a sink to remove excess nitrogen from eukaryotes and as a nitrogen source for prokaryotes. In humans, excess urea is removed from circulation by the kidneys. Levels of blood urea nitrogen therefore are used to assess, e.g., kidney function and the effectiveness of hemodialysis treatment. Urea also is assayed in food compositions such as bovine milk to assess feed efficiency, as well as in alcoholic beverages to detect levels that might result in the production of the carcinogen ethyl carbamate. In the environment, urea is measured to assess pollution resulting from agricultural (e.g., fertilizer run-off) and industrial activities.

Fluorescently responsive sensors (FRSs) based on engineered proteins that couple ligand-binding events to changes in the emission properties of fluorophores (being fluorescent by themselves and regardless of the presence of any other fluorophore/partner) or semi-synthetically incorporated chromophores have wide-ranging applications in cell biology and analytical chemistry. If the fluorescence emission spectrum of an engineered FRS changes shape in response to ligand binding such that the ratio of intensities at two appropriately chosen wavelengths reports on ligand concentration (dichromatic response), then ratiometric measurements can be used to monitor analyte concentrations. Ratiometry is essential for devices that rely on changes in fluorescence emission intensities, because it provides an internally consistent reference. The self-calibrating nature of a ratiometric measurement removes the necessity for carrying out on-board calibration tests prior to each measurement, obviating the need for multiple components and fluidic circuitry. Accordingly, reagentless, ratiometric fluorescent sensors have many uses in process engineering, environmental or clinical chemistry, including single-use point-of-care applications, wearable devices, or implanted "tattoos" that are interrogated transdermally.

The periplasmic binding protein (PBP) superfamily provide a rich source of FRSs, because PBPs combine a large diversity of ligand specificities with a common structural mechanism that is well suited to the construction of fluorescence signal transduction schemes. The three-dimensional PBP monomer structure comprises two $\alpha/\beta$ domains linked by a $\beta$-strand hinge. Binding of ligand is accompanied by a large hinge-bending motion that transitions the protein from an open to a closed state in which the ligand is enveloped within a cleft between the two domains. Semisynthetic FRSs can be engineered with PBPs by site-specifically attaching single, thiol-reactive, environmentally sensitive fluorophores that respond to the ligand-mediated conformational change (FIGS. 1A-D). For example, semisynthetic, fluorescently labeled glucose-binding proteins in the periplasmic binding protein superfamily have been engineered successfully as reagentless, ratiometric glucose biosensors that can be used for point-of-care diagnostics and in vivo continuous glucose monitoring applications.

Urea plays a significant role in the global nitrogen cycle, functioning both as a sink to remove excess nitrogen from eukaryotes and as a nitrogen source for prokaryotes. In humans, excess urea is removed from circulation by the kidneys. Levels of blood nitrogen therefore are used to assess kidney function and the effectiveness of hemodialysis treatment. Urea also is assayed in food, including bovine milk to assess feed efficiency, and in alcoholic beverages to detect levels that might result in the production of the carcinogen ethyl carbamate. In the environment, urea is measured to assess pollution resulting from agricultural (fertilizer run-off) and industrial activities. Urea concentrations typically are measured enzymatically with urease. Enzyme activity is determined by measuring reaction product (protons, ammonium, bicarbonate), either colorimetrically in coupled enzyme assays, or with ion-selective electrodes, or a plethora of other physical techniques. Although these assays can perform well, all are sensitive to inhibition of urease activity, or alternative sources of product (e.g. pH fluctuations, dissolved $CO_2$); some require multiple reagents (e.g. coupled enzymes), or multi-component detectors (e.g. membranes and compartments of ion-selective electrodes). Here we report the development of a simple, single-component, reagentless assay based on robust, genetically engineered periplasmic urea-binding proteins that interact directly with urea to transduce concentrations into ratiometric fluorescent signals.

Biosensors

Biosensors are molecular recognition elements that transduce ligand-binding events into physical signals. Biosensors as detailed herein bind at least one ligand and emit a signal. A ligand-bound biosensor results in a signal that is different from the unbound biosensor. This difference facilitates detection of the at least one ligand and/or determination of ligand concentration. The biosensors may be used without the assistance of other reagents.

Described herein are novel engineered biosensors. These biosensors may have altered ligand-binding affinities, tailored ligand-binding specificities, and/or temperature dependencies of ligand binding or stability. For example, the herein described engineered urea biosensors provide high-accuracy information related to extended urea concentration ranges.

Binding of ligand mediates conformational changes in the biosensor, such as hinge-bending motions of the polypeptide. The conformational changes affect the environment of the reporter such that a change in the reporter-generated signal occurs. That is, without ligand bound, the biosensor results in signal generated from the reporter, and when ligand is bound, the signal generated from the reporter group changes. The ligand-bound biosensor results in a reporter-generated signal that is different from the unbound biosensor.

In some embodiments, the methods and compositions include a plurality of a single type of biosensor. The biosensors may be identical in structure and function. For example, the biosensors of a single type may have the same polypeptide, the same reporter, and the same ligand affinity.

In other embodiments, the methods and compositions include a plurality of different types of biosensors. A plurality of these different types of biosensors may be arranged or incorporated in a panel. As used herein, a "panel" refers to two or more biosensors. The two or more biosensors may be different from each other. The biosensors may differ in structure and/or function. Biosensors may differ in polypeptide sequence, reporter, ligand affinities, or a combination thereof. Accordingly, there may be different types of biosensors. In some embodiments, each biosensor in the panel comprises the same reporter group. In some embodiments, each biosensor in the panel comprises a different reporter group. The panel may include at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, or at least 100 biosensors.

The panel of biosensors includes at least one sensor element. "Sensor element" refers to a single spot, site, location, or well for the at least one biosensor, to which a sample or aliquot thereof may be applied. The panel may be a composite sensor or an array.

In some embodiments, the panel is a composite sensor. In a composite sensor, each sensor element includes a mixture of two or more different biosensors. In some embodiments, the composite sensor includes one sensor element. In some embodiments, the composite sensor includes two or more sensor elements. In some embodiments, signals are measured from a composite sensor in which the signals arise from one or more biosensors in the sensor element. For example, signals may be measured from a composite sensor in which the signals arise from a subset of the total number of biosensors in the sensor element. For example, signals may be measured from a composite sensor in which the signals arise from two of five biosensors in the sensor element.

In some embodiments, the panel is an array. In an array, each sensor element includes a single type of biosensor. An array comprises a plurality of individually and spatially localized sensor elements. Each sensor element includes a biosensor that is different than or the same as the biosensor of a different sensor element. In some embodiments, signals are measured from an array in which the signals arise separately from two or more selected biosensors in separate sensor elements. An array may comprise a plurality of sensor elements of a variety of sizes and configurations. An array may comprise a plurality of sensor elements arranged linearly. For example, an array may comprise a plurality of micrometer-sized sensor elements arranged in a single row. An array may comprise a plurality of sensor elements arranged in a grid. The grid may be two- or three-dimensional. In some embodiments, the grid is a spatially addressable grid. In some embodiments, the biosensors are incorporated into an array, such as a multichannel or multiplexed array.

The biosensors of the present disclosure can be used in any setting where urea detection is required or desired, such a medical setting (e.g., determining the level of blood urea in a subject), environmental setting (e.g., determining the level of urea in an environmental sample), biological setting (e.g., determining the presence or amount of urea in a reaction), or in process engineering, such as monitoring the amount of urea in a fermentation reaction (e.g., a bacterial culture, a yeast culture, beer/wine production, etc.). Other examples include, but are not limited to, uses in the food industry (Suleiman et al., 1992, *In: Biosensor Design and Application*: Mathewson and Finley Eds; American Chemical Society, Washington, DC vol. 511); in clinical chemistry (Wilkins et al., 1996, *Med. Eng. Phys.*, 18, 273-288; Pickup, Tr., 1993, *Biotech.*, 11, 285-291; Meyerhoff et al., 1966, *Endricon*, 6, 51-58; Riklin et al., 1995, *Nature*, 376, 672-675); Willner et al., 1996, *J. Am. Chem. Soc.*, 118, 10321-10322); as the basis for the construction of a fluorescent flow cell containing immobilized ligand binding protein-FAST conjugates (see, e.g., Wilkins et al., 1966, *Med. Eng. Phys.*, 18, 273-288; Pickup, Tr., 1993, *Biotech.*, 11, 285-291; Meyerhoff et al., 1966, *Endricon.*, 6, 51; Group, 1993, *New Engl. J. Med.*, 329, 977-986; Gough et al., 1995, *Diabetes*, 44, 1005-1009); and in an implantable devices.

The biosensors as detailed herein may be administered in a variety of ways known by those of skill in the art, as appropriate for each application. Biosensors may be provided in a solution. The solution may be buffered. Biosensors may be provided in a solution and mixed directly with a sample. In some embodiments, a biosensor is immobilized onto a surface. Biosensors may be immobilized within a disposable cartridge into which a sample may be introduced or applied. Biosensors may be implanted or incorporated in a wearable device. The biosensor may be provided as an optode.

The biosensor may be attached to or incorporated in a wearable device. Wearable devices may include, for example, adhesive strips, patches, and contact lenses. The biosensor may be configured for placement in contact with a subject's skin or mucosal surface. In some embodiments, the biosensor is configured as an adhesive strip. In some embodiments, the biosensor is configured within or on the surface of a contact lens. In some embodiments, the contact lens is formed from a transparent substrate shaped to be worn directly over a subject's eye, as described in, for example, U.S. Pat. No. 8,608,310.

The biosensor may be implanted. The biosensor may be implanted in a subject's body. The biosensor may be implanted in a subject's blood vessel, vein, eye, natural or artificial pancreas, skin, or anywhere in the alimentary canal including the stomach, intestine and esophagus. The biosensor may be implanted in a subject with a microbead. In some embodiments, the biosensor is configured to be implanted in the skin. The biosensor may be implanted in a subject sub-dermally. The biosensor may generate the signal transdermally. In some embodiments, the biosensor may be implanted in a subject with transdermal microbeads, wherein the optical signals can be transmitted remotely between the biosensor and detecting device.

In some embodiments, the biosensor is administered as an optode. As used herein, "optode" refers to an optical fiber with a single biosensor, or a composite biosensor, immobilized at the surface or at the end. An "optode" may also be referred to as an "optrode." In some embodiments, the biosensor is implanted in a subject as an optode. The optode may be incorporated with or into a needle. The optode may be incorporated with a probe such as endoscopy or colonoscopy probes. The optode may be used in a tumor, near a tumor, or at the periphery of a tumor. In some embodiments, the biosensor may be implanted in a subject as an optode, wherein the optical signals can be transmitted between the biosensor and detecting device using physical links. In some embodiments, the biosensor is administered as an optode to a sample or reaction. The optode may be contacted with a sample or reaction. In some embodiments, an optode is used to continuously or episodically monitor a ligand in a sample or reaction.

Methods of Detecting the Presence of a Ligand

Provided herein is a method of detecting the presence of a ligand in a sample. The method may include contacting the biosensor with the sample; measuring a signal from the biosensor; and comparing the signal to a ligand-free control. A difference in signal indicates the presence of ligand in the sample.

Also provided herein is a method of detecting the presence of urea in a sample. The method may include (a) providing a urea biosensor disclosed herein in which the reporter group is attached the urea so that a signal transduced by the reporter group when the urea is bound to urea differs from a signal transduced by the reporter group when the urea is not bound to urea; (b) contacting the biosensor with the test sample under conditions such that the biosensor can bind to urea present in the test sample; and (c) comparing the signal transduced by the reporter group when the biosensor is contacted with the test sample with the signal transduced by the reporter group when the biosensor is contacted with a urea-free control sample, wherein a difference in the signal transduced by the reporter group when the biosensor is contacted with the test sample, as compared to when the biosensor is contacted with the control sample, indicates that the test sample contains urea.

Methods of Determining the Concentration of a Ligand

Provided herein is a method of determining the concentration of a ligand in a sample. The method may include contacting the biosensor with the sample; measuring a signal from the biosensor; and comparing the signal to a standard hyperbolic ligand binding curve to determine the concentration of ligand in the test sample. The standard hyperbolic ligand binding curve may be prepared by measuring the signal transduced by the biosensor when contacted with control samples containing known concentrations of ligand.

Another aspect of the present disclosure provides a method of determining the concentration of urea in a test sample comprising, consisting of, or consisting essentially of: (a) providing a urea biosensor comprising a urea-binding protein as described herein in which the reporter group is attached the urea-binding protein so that a signal transduced by the reporter group when the urea-binding protein is bound to urea differs from a signal transduced by the reporter group when the urea-binding protein is not bound to urea; (b) contacting the biosensor with the test sample under conditions such that the biosensor can bind to urea present in the test sample; and (c) comparing the signal transduced by the reporter group when the biosensor is contacted with the test sample with a standard hyperbolic urea binding curve prepared by measuring the signal transduced by the reporter group when the biosensor is contacted with control samples containing known quantities of urea to determine the concentration of urea in the test sample.

Methods of Monitoring the Presence of a Ligand

The present invention is directed to a method of episodically or continuously monitoring the presence of a ligand in a reaction. In certain embodiments, the biosensors may be used in the continuous monitoring of urea in a reaction. In certain embodiments, the urea sensors may be used in episodic monitoring of sample aliquots.

The method of episodically or continuously monitoring the presence of a ligand in a reaction may include contacting the biosensor with the reaction; maintaining the reaction under conditions such that the polypeptide is capable of binding ligand present in the reaction; and episodically or continuously monitoring the signal from the biosensor in the reaction.

The method of episodically or continuously monitoring the presence of a ligand in a reaction may include contacting the biosensor with the reaction; maintaining the reaction under conditions such that the polypeptide is capable of binding ligand present in the reaction; episodically or continuously monitoring the signal from the biosensor in the reaction; and comparing the signal to a standard hyperbolic ligand binding curve to determine the concentration of ligand in the test sample. The standard hyperbolic ligand binding curve may be prepared by measuring the signal transduced by the biosensor when contacted with control samples containing known concentrations of ligand.

In some embodiments, the method further includes comparing the signal to a ligand-free control, wherein a difference in signal indicates the presence of ligand in the reaction.

In some embodiments, the method further includes comparing the signal to a standard hyperbolic ligand binding curve to determine the concentration of ligand in the test sample. The standard hyperbolic ligand binding curve may be prepared by measuring the signal transduced by the biosensor when contacted with control samples containing known concentrations of ligand.

Another aspect of the present disclosure provides a method of continuously monitoring the presence of urea in a reaction comprising, consisting of, or consisting essentially of: (a) providing a urea biosensor as described herein in which the reporter group is attached a urea-binding protein so that a signal transduced by the reporter group when the urea-binding protein is bound to urea differs from a signal transduced by the reporter group when the urea-binding protein is not bound to urea; (b) maintaining the biosensor within the reaction and under conditions such that the biosensor can bind to urea present in the reaction; (c) continuously monitoring the signal transduced by the reporter group when the biosensor is contacted with the urea present in the reaction; and optionally (d) comparing the signal transduced by the reporter group when the biosensor is contacted with the urea present in the reaction with the signal transduced by the reporter group when the biosensor is contacted with a urea-free control sample, wherein a difference in the signal transduced by the reporter group when the biosensor is contacted with the urea present in the reaction, as compared to when the biosensor is contacted with the control sample, indicates urea is present in the reaction.

Yet another aspect of the present disclosure provides a method of continuously monitoring the concentration of urea in a reaction comprising, consisting of, or consisting essentially of: (a) providing a urea biosensor comprising a urea biosensor as described herein in which the reporter group is attached a urea-binding protein so that a signal transduced by the reporter group when the urea-binding protein is bound to urea differs from a signal transduced by the reporter group when the urea-binding protein is not bound to urea; (b) maintaining the biosensor within the reaction under conditions such that the biosensor can bind to urea present in the reaction; and (c) continuously monitoring the signal transduced by the reporter group when the biosensor is contacted with the urea present in the reaction; and (d) comparing the signal transduced by the reporter group when the biosensor is contacted with the urea present in the reaction with a standard hyperbolic urea binding curve prepared by measuring the signal transduced by the reporter group when the biosensor is contacted with control samples containing known quantities of urea to determine the concentration of urea in the reaction.

Non-Limiting Examples Described Herein

To construct non-limiting examples of urea sensors based on engineered PBPs, we used bioinformatics to accurately identify urea-binding proteins (UBPs) in publicly available prokaryotic genomic sequences. Starting with the sequences of two genetically and biochemically characterized periplasmic urea-binding proteins (Valladeres, 2002, *Molec. Microbiol.*, 43, 703-715; Beckers, 2004, *J. Bacteriol.*, 186, 7645-7652; Siewe, 1998, *Arch. Microbiol.*, 169, 411-416), we identified distantly related urea-binding proteins in thermophilic bacteria. To accurately define the binding function in the set of initial sequence homologs, we applied a combination of genomic contextual and three-dimensional protein structural information. The proteins for a small subset of sequences identified in this manner were prepared by heterologous expression of synthetic genes, optimized for heterologous expression in *E. coli* (Allert, Cox and Hellinga, 2010, *J Mol Biol*, 402, 905-18). The urea-binding properties of these proteins were measured using a thermal stability shift assay (Layton and Hellinga, 2010, *Biochemistry*, 49, 10831-41). All the proteins that expressed in soluble form bound urea with micromolar or better affinity, confirming the accuracy of the gene function prediction.

The structure of the UBP from *Caldicellulosiruptor saccharolyticus* (csUBP7), a thermophilic bacterium, was determined by X-ray crystallography. This structure was used to refine the bioinformatic definition of urea-binding proteins, and in the protein engineering strategy used to convert csUBP7 into a non-limiting example of a fluorescently responsive urea biosensor.

Conjugates of the environmentally sensitive, thiol-reactive fluorophores Acrylodan and Badan were attached to a series of single-cysteine mutants of csUBP7 and two other homologs and screened for fluorescent urea responses. Two csUBP7 conjugates, csUBP95C and csUBP186C, gave good ratiometric responses. The performance of the csUBP186C conjugate was further optimized by constructing a doubly labeled sensor in which the environmentally sensitive response of Alexa532 placed at 186C was coupled via fluorescence resonance energy transfer to an Acrylodan placed at thiols in a fusion domain. Under the right conditions, such non-geometrically modulated FRET (ngmFRET) pairs can convert linear quenching effects into ratiometric responses.

Matching of affinities with pathophysiological concentration ranges [below (less than about 2 mM), within (about 2 mM to about 7 mM), or above (greater than about 7 mM) normal human serum levels] is essential for constructing sensors that perform with sufficient precision to enable accurate clinical chemometrics. Of the csUBP7 conjugates that gave ratiometric response, csUBP7 186C was selected for further mutagenesis to "tune" its affinity and place the mid-point of the binding curve within the concentration range of urea in blood (Burtis, 2012, Tietz Textbook of Clinical Chemistry and Molecular Diagnostics. Elsevier) (1.8-7.1 mM) whereas csUBP7 95C already was in the correct clinical range. Mutants of csUBP7 186C were identified with urea affinities in the 0.001-100 mM range. One of these, Q114A, was selected for further optimization of its fluorescence. The engineered csUBP7 mutants and ngmFRET constructs reported here therefore comprise a robust set of sensors for detecting urea in the clinical pathophysiological concentration range.

Immobilization of FRSs on solid surfaces with minimal perturbation of the molecular sensing mechanism is an important step for incorporating biosensors into devices. Immobilization enables retention of the sensor within the sampling element (e.g. optode surface or implanted bead for in vivo sensing applications; or in a sample-handling cartridge for ex vivo sensing). Immobilization also may provide spatial localization to provide the necessary addressability of different elements in a multi-sensor array comprising sensors that differ in their engineered affinities for coverage of a wide range of urea concentrations, or sensors that each detect distinct analytes.

Ex vivo clinical chemistries such as point-of-care applications require that the FRS is incorporated into a cartridge into which a sample is introduced at the time of measurement. Such "disposables" need to have a long shelf life that preferably does not require temperature control (e.g. refrigeration) for storage or distribution. It is preferable to incorporate immobilized protein in a stable, dried form in such disposables. The resistance to denaturation of thermostable proteins minimizes the need for temperature control during manufacturing and storage, and may extend to the long-term stability of a desiccated state.

The spectral response, binding affinity, and thermostability of the robust thermostable UBP FRSs reported here are conserved following site-specific immobilization on beads. Furthermore, these properties are generally retained upon reconstitution following drying. The engineered proteins provided herein are useful for robust, high-precision, wide-dynamic range urea sensing applications, including continuous monitoring, point-of-care, wearable sensor systems.

General Definitions

Unless specifically defined otherwise, all technical and scientific terms used herein shall be taken to have the same meaning as commonly understood by one of ordinary skill in the art (e.g., in cell culture, molecular genetics, and biochemistry).

As used herein, the term "about" in the context of a numerical value or range means ±10% of the numerical value or range recited or claimed, unless the context requires a more limited range.

In the descriptions above and in the claims, phrases such as "at least one of" or "one or more of" may occur followed by a conjunctive list of elements or features. The term "and/or" may also occur in a list of two or more elements or features. Unless otherwise implicitly or explicitly contradicted by the context in which it is used, such a phrase is intended to mean any of the listed elements or features individually or any of the recited elements or features in combination with any of the other recited elements or features. For example, the phrases "at least one of A and B;" "one or more of A and B;" and "A and/or B" are each intended to mean "A alone, B alone, or A and B together." A similar interpretation is also intended for lists including three or more items. For example, the phrases "at least one of A, B, and C;" "one or more of A, B, and C;" and "A, B, and/or C" are each intended to mean "A alone, B alone, C alone, A and B together, A and C together, B and C together, or A and B and C together." In addition, use of the term "based on," above and in the claims is intended to mean, "based at least in part on," such that an unrecited feature or element is also permissible It is understood that where a parameter range is provided, all integers within that range, and tenths thereof, are also provided by the invention. For example, "0.2-5 mg" is a disclosure of 0.2 mg, 0.3 mg, 0.4 mg, 0.5 mg, 0.6 mg etc. up to and including 5.0 mg.

A small molecule is a compound that is less than 2000 daltons in mass. The molecular mass of the small molecule is preferably less than 1000 daltons, more preferably less than 600 daltons, e.g., the compound is less than 500 daltons, 400 daltons, 300 daltons, 200 daltons, or 100 daltons.

As used herein, an "isolated" or "purified" nucleic acid molecule, polynucleotide, polypeptide, or protein, is substantially free of other cellular material, or culture medium when produced by recombinant techniques, or chemical precursors or other chemicals when chemically synthesized. Purified compounds are at least 60% by weight (dry weight) the compound of interest. Preferably, the preparation is at least 75%, more preferably at least 90%, and most preferably at least 99%, by weight the compound of interest. For example, a purified compound is one that is at least 90%, 91%, 92%, 93%, 94%, 95%, 98%, 99%, or 100% (w/w) of the desired compound by weight. Purity is measured by any appropriate standard method, for example, by column chromatography, thin layer chromatography, or high-performance liquid chromatography (HPLC) analysis. A purified or isolated polynucleotide (ribonucleic acid (RNA) or deoxyribonucleic acid (DNA)) is free of the genes/nucleic acids or sequences/amino acids that flank it in its naturally-occurring state. Purified also defines a degree of sterility that is safe for administration to a human subject, e.g., lacking infectious or toxic agents.

Similarly, by "substantially pure" is meant a nucleotide or polypeptide that has been separated from the components that naturally accompany it. Typically, the nucleotides and polypeptides are substantially pure when they are at least 60%, 70%, 80%, 90%, 95%, or even 99%, by weight, free from the proteins and naturally-occurring organic molecules with they are naturally associated.

The transitional term "comprising," which is synonymous with "including," "containing," or "characterized by," is inclusive or open-ended and does not exclude additional, unrecited elements or method steps. By contrast, the transitional phrase "consisting of" excludes any element, step, or ingredient not specified in the claim. The transitional phrase "consisting essentially of" limits the scope of a claim to the specified materials or steps "and those that do not materially affect the basic and novel characteristic(s)" of the claimed invention.

"Subject" as used herein refers to any organism from which a biological sample is obtained. For example, the sample is a biological fluid or tissue. For example, a subject is one who wants or is in need of detecting ligand or determining the concentration of ligand with the herein described biosensors. The subject may be a human or a non-human animal. The subject may be a mammal. The mammal may be a primate or a non-primate. The mammal can be a primate such as a human; a non-primate such as, for example, dog, cat, horse, cow, pig, mouse, rat, camel, llama, goat, rabbit, sheep, hamster, and guinea pig; or non-human primate such as, for example, monkey, chimpanzee, gorilla, orangutan, and gibbon. The subject may be of any age or stage of development, such as, for example, an adult, an adolescent, or an infant.

As used herein, an "expression vector" is a DNA or RNA vector that is capable of effecting expression of one or more polynucleotides. Preferably, the expression vector is also capable of replicating within the host cell. Expression vectors can be either prokaryotic or eukaryotic, and are typically include plasmids. Expression vectors of the present invention include any vectors that function (i.e., direct gene expression) in host cells of the present invention, including in one of the prokaryotic or eukaryotic cells described herein, e.g., gram-positive, gram-negative, pathogenic, non-pathogenic, commensal, cocci, *bacillus*, or spiral-shaped bacterial cells; archaeal cells; or protozoan, algal, fungi, yeast, plant, animal, vertebrate, invertebrate, arthropod, mammalian, rodent, primate, or human cells. Expression vectors of the present invention contain regulatory sequences such as transcription control sequences, translation control sequences, origins of replication, and other regulatory sequences that are compatible with the host cell and that control the expression of a polynucleotide. In particular, expression vectors of the present invention include transcription control sequences. Transcription control sequences are sequences which control the initiation, elongation, and termination of transcription. Particularly important transcription control sequences are those which control transcription initiation such as promoter, enhancer, operator and repressor sequences. Suitable transcription control sequences include any transcription control sequence that can function in at least one of the cells of the present invention. A variety of such transcription control sequences are known to those skilled in the art.

As used herein, the singular forms "a," "an," and "the" include the plural reference unless the context clearly dictates otherwise. Thus, for example, a reference to "a disease," "a disease state", or "a nucleic acid" is a reference to one or more such embodiments, and includes equivalents thereof known to those skilled in the art and so forth.

As used herein, "pharmaceutically acceptable" carrier or excipient refers to a carrier or excipient that is suitable for use with humans and/or animals without undue adverse side effects (such as toxicity, irritation, and allergic response) commensurate with a reasonable benefit/risk ratio. It can be, e.g., a pharmaceutically acceptable solvent, suspending agent or vehicle, for delivering the instant compounds to the subject.

The term "diagnosis" refers to a determination that a disease is present in the subject. Similarly, the term "prognosis" refers to a relative probability that a certain future outcome may occur in the subject. For example, in the context of the present disclosure, prognosis can refer to the likelihood that an individual will develop a disease, or the likely severity of the disease (e.g., severity of symptoms, rate of functional decline, survival, etc.).

Unless required otherwise by context, the terms "polypeptide" and "protein" are used interchangeably.

A polypeptide or class of polypeptides may be defined by the extent of identity (% identity) of its amino acid sequence to a reference amino acid sequence, or by having a greater % identity to one reference amino acid sequence than to another. A variant of any of genes or gene products disclosed herein may have, e.g., 50%, 55%, 60%, 65%, 70%, 75%, 80%, 85%, 90%, 95%, 96%, 97%, 98%, or 99% sequence identity to the nucleic acid or amino acid sequences described herein. The term "% identity," in the context of two or more nucleic acid or polypeptide sequences, refers to two or more sequences or subsequences that are the same or have a specified percentage of amino acid residues or nucleotides that are the same, when compared and aligned for maximum correspondence, as measured using a sequence comparison algorithm or by visual inspection. For example, % identity is relative to the entire length of the coding regions of the sequences being compared, or the length of a particular fragment or functional domain thereof. Variants as disclosed herein also include homologs, orthologs, or paralogs of the genes or gene products described herein. In some embodiments, variants may demonstrate a percentage of homology or identity, for example, at least about 50%, 55%, 60%, 65%, 70%, 75%, 80%, 85%, 90%, 95%, 96%, 97%, 98%, or 99% identity conserved domains important for biological function, e.g., in a functional domain, e.g. a ligand-binding or catalytic domain.

For sequence comparison, one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters. Percent identity is determined using BLAST. For the BLAST searches, the following parameters were employed: (1) Expect threshold is 10; (2) Gap cost is Existence:11 and Extension:1; (3) The Matrix employed is BLOSUM62; (4) The filter for low complexity regions is "on."

The present invention also provides for functional fragments of the genes or gene products described herein. A fragment of a protein is characterized by a length (number of amino acids) that is less than the length of the full length mature form of the protein. A fragment, in the case of these sequences and all others provided herein, may be a part of the whole that is less than the whole. Moreover, a fragment ranges in size from a single nucleotide or amino acid within a polynucleotide or polypeptide sequence to one fewer nucleotide or amino acid than the entire polynucleotide or polypeptide sequence. Finally, a fragment is defined as any portion of a complete polynucleotide or polypeptide sequence that is intermediate between the extremes defined above.

For example, fragments of any of the proteins or enzymes disclosed herein or encoded by any of the genes disclosed herein can be 10 to 20 amino acids, 10 to 30 amino acids, 10 to 40 amino acids, 10 to 50 amino acids, 10 to 60 amino acids, 10 to 70 amino acids, 10 to 80 amino acids, 10 to 90 amino acids, 10 to 100 amino acids, 50 to 100 amino acids, 75 to 125 amino acids, 100 to 150 amino acids, 150 to 200 amino acids, 200 to 250 amino acids, 250 to 300 amino acids, 300 to 350, 300 to 375, or 350 to 400 amino acids. The fragments encompassed in the present subject matter comprise fragments that retain functional fragments. As such, the fragments preferably retain the binding domains that are required or are important for functional activity. Fragments can be determined or generated by using the sequence information herein, and the fragments can be tested for functional activity using standard methods known in the art. For example, the encoded protein can be expressed by any recombinant technology known in the art and the binding activity of the protein can be determined.

As used herein a "biologically active" fragment is a portion of a polypeptide which maintains an activity of a full-length reference polypeptide. Biologically active fragments as used herein exclude the full-length polypeptide. Biologically active fragments can be any size as long as they maintain the defined activity. Preferably, the biologically active fragment maintains at least 10%, at least 50%, at least 75% or at least 90%, of the activity of the full length protein.

Amino acid sequence variants/mutants of the polypeptides of the defined herein can be prepared by introducing appropriate nucleotide changes into a nucleic acid defined herein, or by in vitro synthesis of the desired polypeptide. Such variants/mutants include, for example, deletions, insertions or substitutions of residues within the amino acid sequence. A combination of deletion, insertion and substitution can be made to arrive at the final construct, provided that the final peptide product possesses the desired activity and/or specificity.

Mutant (altered) peptides can be prepared using any technique known in the art. For example, a polynucleotide defined herein can be subjected to in vitro mutagenesis or DNA shuffling techniques as broadly described by Harayama (1998). Products derived from mutated/altered DNA can readily be screened using techniques described herein to determine if they possess, for example, urea binding activity.

In designing amino acid sequence mutants, the location of the mutation site and the nature of the mutation will depend on characteristic(s) to be modified. The sites for mutation can be modified individually or in series, e.g., by (1) substituting first with conservative amino acid choices and then with more radical selections depending upon the results achieved, (2) deleting the target residue, or (3) inserting other residues adjacent to the located site.

Amino acid sequence deletions generally range from about 1 to 15 residues, more preferably about 1 to 10 residues and typically about 1 to 5 contiguous residues. In some embodiments, a mutated or modified protein does not comprise any deletions or insertions. In various embodiments, a mutated or modified protein has less than about 10, 9, 8, 7, 6, 5, 4, 3, or 2 deleted or inserted amino acids.

Substitution mutants have at least one amino acid residue in the polypeptide molecule removed and a different residue inserted in its place. Sites may be substituted in a relatively conservative manner in order to maintain activity and/or specificity. Such conservative substitutions are shown in the table below under the heading of "exemplary substitutions."

In certain embodiments, a mutant/variant polypeptide has only, or not more than, one or two or three or four conservative amino acid changes when compared to a naturally occurring polypeptide. Details of conservative amino acid changes are provided in the table below. As the skilled person would be aware, such minor changes can reasonably be predicted not to alter the activity of the polypeptide when expressed in a recombinant cell.

Exemplary Substitutions

| Original Residue | Exemplary Substitutions |
| --- | --- |
| Alanine (Ala) | Val; Leu; Ile; Gly |
| Arginine (Arg) | Lys |
| Asparagine (Asn) | Gln; His |
| Cysteine (Cys) | Ser |
| Glutamine (Gln) | Asn; His |
| Glutamic Acid (Glu) | Asp |
| Glycine (Gly) | Pro; Ala |
| Histidine (His) | Asn; Gln |
| Isoleucine (Ile) | Leu; Val; Ala |
| Leucine (Leu) | Ile; Val; Met; Ala; Phe |
| Lysine (Lys) | Arg |
| Methionine (Met) | Leu; Phe |
| Phenylalanine (Phe) | Leu; Val; Ala |
| Proline (Pro) | Gly |
| Serine (Ser) | Thr |
| Threonine (Thr) | Ser |
| Tryptophan (Trp) | Tyr |
| Tyrosine (Tyr) | Trp; Phe |
| Valine (Val) | Ile; Leu; Met; Phe; Ala |

Mutations can be introduced into a nucleic acid sequence such that the encoded amino acid sequence is altered by standard techniques, such as site-directed mutagenesis and PCR-mediated mutagenesis. Preferably, conservative amino acid substitutions are made at one or more predicted nonessential amino acid residues. A "conservative amino acid substitution" is one in which the amino acid residue is replaced with an amino acid residue having a similar side chain. Families of amino acid residues having similar side chains have been defined in the art. Certain amino acids have side chains with more than one classifiable characteristic. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, tryptophan, cysteine), nonpolar side chains (e.g., alanine, valine, leucine, isoleucine, proline, phenylalanine, methionine, tyrosine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a given polypeptide is replaced with another amino acid residue from the same side chain family. Alternatively, in another embodiment, mutations can be introduced randomly along all or part of a given coding sequence, such as by saturation mutagenesis, and the resultant mutants can be screened for given polypeptide biological activity to identify mutants that retain activity. Conversely, the invention also provides for variants with mutations that enhance or increase the endogenous biological activity. Following mutagenesis of the nucleic acid sequence, the encoded protein can be expressed by any recombinant technology known in the art and the activity/specificity of the protein can be determined. An increase, decrease, or elimination of a given biological activity of the variants disclosed herein can be readily measured by the ordinary person skilled in the art, i.e., by measuring the capability for binding a ligand and/or signal transduction.

In various embodiments, a polypeptide comprises mutations such that 1, 2, 3, 4, 5, 6, 7, 8, 9, or 10, or less than about 10, 9, 8, 7, 6, 5, 4, 3, or 2 amino acids is substituted with a cysteine and/or a lysine.

Polypeptides can be produced in a variety of ways, including production and recovery of natural polypeptides or recombinant polypeptides according to methods known in the art. In one embodiment, a recombinant polypeptide is produced by culturing a cell capable of expressing the polypeptide under conditions effective to produce the polypeptide, such as a host cell defined herein.

| SEQ ID NO | Sequence Name |
|---|---|
| 1 | mpUBP1; [U.S. National Center for Biotechnology Information (NCBI) Accession Nos. YP_004483096.1 and WP_013797647.1] |
| 2 | mhUBP2; [U.S. National Center for Biotechnology Information (NCBI) Accession Nos. YP_005430828.1 and WP_014422383.1] |
| 3 | bsUBP3; [U.S. National Center for Biotechnology Information (NCBI) Accession Nos. YP_006233530.1 and WP_014665698.1] |
| 4 | dcUBP4; [U.S. National Center for Biotechnology Information (NCBI) Accession Nos. YP_004496535.1 and WP_013809819.1] |
| 5 | gtUBP5; [U.S. National Center for Biotechnology Information (NCBI) Accession Nos. YP_004588319.1 and WP_013877063.1] |
| 6 | ctUBP6; [U.S. National Center for Biotechnology Information (NCBI) Accession Nos. YP_001038237.1 and WP_003515797.1] |
| 7 | csUBP7; [U.S. National Center for Biotechnology Information (NCBI) Accession Nos. YP_001181243.1 and WP_011917972.1] |
| 8 | taUBP8; [U.S. National Center for Biotechnology Information (NCBI) Accession Nos. YP_003473480.1 and WP_012991759.1] |
| 9 | gkUBP10; [U.S. National Center for Biotechnology Information (NCBI) Accession Nos. YP_147790.1 and WP_011231423.1] |
| 10 | psUBP11; [U.S. National Center for Biotechnology Information (NCBI) Accession Nos. YP_003241723.1 and WP_015734090.1] |
| 11 | teUBP12; [U.S. National Center for Biotechnology Information (NCBI) Accession Nos. NP_681910.1 and WP_011567844.1] |
| 12 | mpUBP1 (with signal peptide replaced with M and a GGSHHHHHH at C-terminus, and also comprising C75A, C385A, and C395A mutations) |
| 13 | mhUBP2 (with signal peptide replaced with M and a GGSHHHHHH at C-terminus, and also comprising C385A and C395A mutations) |
| 14 | bsUBP3 (with signal peptide replaced with M and a GGSHHHHHH at C-terminus) |
| 15 | dcUBP4 (with signal peptide replaced with M and a GGSHHHHHH at C-terminus) |
| 16 | gtUBP5 (with signal peptide replaced with M and a GGSHHHHHH at C-terminus) |
| 17 | ctUBP6 (with signal peptide replaced with M and a GGSHHHHHH at C-terminus) |
| 18 | csUBP7 (with signal peptide replaced with M and a GGSHHHHHH at C-terminus, and also comprising a C89A substitution) |
| 19 | taUBP8 (with signal peptide replaced with M and a GGSHHHHHH at C-terminus, and also comprising C141A and C402A substitutions) |
| 20 | gkUBP10 (with signal peptide replaced with M, which is followed by a FATT domain, followed by a sequence fragment for C3 protease, and with a GGSHHHHHH at C-terminus) |
| 21 | psUBP11 (with signal peptide replaced with M, which is followed by a FATT domain, followed by a sequence fragment for C3 protease, and with a GGSHHHHHH at C-terminus) |
| 22 | teUBP12 (with signal peptide replaced with M, which is followed by a FATT domain, followed by a sequence fragment for C3 protease, and with a GGSHHHHHH at C-terminus, as well as C185A, C216A, and C481A mutations) |
| 23 | csUBP7_26C (26C substitution mutant with signal peptide replaced with M and a GGSHHHHHH at C-terminus, and also comprising a C89A substitution) |
| 24 | csUBP7_27C (27C substitution mutant with signal peptide replaced with M and a GGSHHHHHH at C-terminus, and also comprising a C89A substitution) |
| 25 | csUBP7_30C (30C substitution mutant with signal peptide replaced with M and a GGSHHHHHH at C-terminus, and also comprising a C89A substitution) |
| 26 | csUBP7_65C (65C substitution mutant with signal peptide replaced with M and a GGSHHHHHH at C-terminus, and also comprising a C89A substitution) |
| 27 | csUBP7_69C (69C substitution mutant with signal peptide replaced with M and a GGSHHHHHH at C-terminus, and also comprising a C89A substitution) |
| 28 | csUBP7_90C (90C substitution mutant with signal peptide replaced with M and a GGSHHHHHH at C-terminus, and also comprising a C89A substitution) |
| 29 | csUBP7_91C (91C substitution mutant with signal peptide replaced with M and a GGSHHHHHH at C-terminus, and also comprising a C89A substitution) |
| 30 | csUBP7_92C (92C substitution mutant with signal peptide replaced with M and a GGSHHHHHH at C-terminus, and also comprising a C89A substitution) |
| 31 | csUBP7_93C (93C substitution mutant with signal peptide replaced with M and a GGSHHHHHH at C-terminus, and also comprising a C89A substitution) |
| 32 | csUBP7_95C (95C substitution mutant with signal peptide replaced with M and a GGSHHHHHH at C-terminus, and also comprising a C89A substitution) |
| 33 | csUBP7_111C (111C substitution mutant with signal peptide replaced with M and a GGSHHHHHH at C-terminus, and also comprising a C89A substitution) |

| SEQ ID NO | Sequence Name |
|---|---|
| 34 | csUBP7_114C (114C substitution mutant with signal peptide replaced with M and a GGSHHHHHH at C-terminus, and also comprising a C89A substitution) |
| 35 | csUBP7_115C (115C substitution mutant with signal peptide replaced with M and a GGSHHHHHH at C-terminus, and also comprising a C89A substitution) |
| 36 | csUBP7_116C (116C substitution mutant with signal peptide replaced with M and a GGSHHHHHH at C-terminus, and also comprising a C89A substitution) |
| 37 | csUBP7_157C (157C substitution mutant with signal peptide replaced with M and a GGSHHHHHH at C-terminus, and also comprising a C89A substitution) |
| 38 | csUBP7_158C (158C substitution mutant with signal peptide replaced with M and a GGSHHHHHH at C-terminus, and also comprising a C89A substitution) |
| 39 | csUBP7_159C (159C substitution mutant with signal peptide replaced with M and a GGSHHHHHH at C-terminus, and also comprising a C89A substitution) |
| 40 | csUBP7_186C (186C substitution mutant with signal peptide replaced with M and a GGSHHHHHH at C-terminus, and also comprising a C89A substitution) |
| 41 | csUBP7_211C (211C substitution mutant with signal peptide replaced with M and a GGSHHHHHH at C-terminus, and also comprising a C89A substitution) |
| 42 | csUBP7_238C (238C substitution mutant with signal peptide replaced with M and a GGSHHHHHH at C-terminus, and also comprising a C89A substitution) |
| 43 | bsUBP3_76C (76C substitution mutant with signal peptide replaced with M and a GGSHHHHHH at C-terminus) |
| 44 | bsUBP3_77C (77C substitution mutant with signal peptide replaced with M and a GGSHHHHHH at C-terminus) |
| 45 | bsUBP3_78C (78C substitution mutant with signal peptide replaced with M and a GGSHHHHHH at C-terminus) |
| 46 | bsUBP3_79C (79C substitution mutant with signal peptide replaced with M and a GGSHHHHHH at C-terminus) |
| 47 | bsUBP3_145C (145C substitution mutant with signal peptide replaced with M and a GGSHHHHHH at C-terminus) |
| 48 | bsUBP3_172C (172C substitution mutant with signal peptide replaced with M and a GGSHHHHHH at C-terminus) |
| 49 | ctUBP6_95C (95C substitution mutant with signal peptide replaced with M and a GGSHHHHHH at C-terminus) |
| 50 | ctUBP6_96C (96C substitution mutant with signal peptide replaced with M and a GGSHHHHHH at C-terminus) |
| 51 | ctUBP6_97C (97C substitution mutant with signal peptide replaced with M and a GGSHHHHHH at C-terminus) |
| 52 | ctUBP6_98C (98C substitution mutant with signal peptide replaced with M and a GGSHHHHHH at C-terminus) |
| 53 | ctUBP6_164C (164C substitution mutant with signal peptide replaced with M and a GGSHHHHHH at C-terminus) |
| 54 | ctUBP6_191C (191C substitution mutant with signal peptide replaced with M and a GGSHHHHHH at C-terminus) |
| 55 | csUBP7_186C.1 (186C, 43Q, 276N, 280M substitution mutant, signal peptide replaced with M and a GGSHHHHHH at C-terminus, and also comprising a C89A substitution) |
| 56 | csUBP7_186C.2 (186C, 288S substitution mutant, signal peptide replaced with M and a GGSHHHHHH at C-terminus, and also comprising a C89A substitution) |
| 57 | csUBP7_186C.3 (186C, 329G substitution mutant, signal peptide replaced with M and a GGSHHHHHH at C-terminus, and also comprising a C89A substitution) |
| 58 | csUBP7_186C.4 (186C, 116Q substitution mutant, signal peptide replaced with M and a GGSHHHHHH at C-terminus, and also comprising a C89A substitution) |
| 59 | csUBP7_186C.5 (186C, 116D substitution mutant, signal peptide replaced with M and a GGSHHHHHH at C-terminus, and also comprising a C89A substitution) |
| 60 | csUBP7_186C.6 (186C, 116A substitution mutant, signal peptide replaced with M and a GGSHHHHHH at C-terminus, and also comprising a C89A substitution) |
| 61 | csUBP7_186C.7 (186C, 30I, 241A substitution mutant, signal peptide replaced with M and a GGSHHHHHH at C-terminus, and also comprising a C89A substitution) |
| 62 | csUBP7_186C.8 (186C, 211S substitution mutant, signal peptide replaced with M and a GGSHHHHHH at C-terminus, and also comprising a C89A substitution) |
| 63 | csUBP7_186C.9 (186C, 114S substitution mutant, signal peptide replaced with M and a GGSHHHHHH at C-terminus, and also comprising a C89A substitution) |
| 64 | csUBP7_186C.10 (186C, 114N substitution mutant, signal peptide replaced with M and a GGSHHHHHH at C-terminus, and also comprising a C89A substitution) |
| 65 | csUBP7_186C.11 (186C, S92A substitution mutant, signal peptide replaced with M and a GGSHHHHHH at C-terminus, and also comprising a C89A substitution) |

-continued

| SEQ ID NO | Sequence Name |
|---|---|
| 66 | csUBP7_186C.12 (186C, Y111A substitution mutant, signal peptide replaced with M and a GGSHHHHHH at C-terminus, and also comprising a C89A substitution) |
| 67 | csUBP7_186C.13 (186C, Y157A substitution mutant, signal peptide replaced with M and a GGSHHHHHH at C-terminus, and also comprising a C89A substitution) |
| 68 | csUBP7_186C.14 (186C, F159A substitution mutant, signal peptide replaced with M and a GGSHHHHHH at C-terminus, and also comprising a C89A substitution) |
| 69 | csUBP7_186C.15 (186C, I13A substitution mutant, signal peptide replaced with M and a GGSHHHHHH at C-terminus, and also comprising a C89A substitution) |
| 70 | csUBP7_186C.16 (186C, I13T substitution mutant, signal peptide replaced with M and a GGSHHHHHH at C-terminus, and also comprising a C89A substitution) |
| 71 | csUBP7_186C.17 (186C, I13N substitution mutant, signal peptide replaced with M and a GGSHHHHHH at C-terminus, and also comprising a C89A substitution) |
| 72 | csUBP7_186C.18 (186C, I13Q substitution mutant, signal peptide replaced with M and a GGSHHHHHH at C-terminus, and also comprising a C89A substitution) |
| 73 | csUBP7_186C.19 (186C, I13H substitution mutant, signal peptide replaced with M and a GGSHHHHHH at C-terminus, and also comprising a C89A substitution) |
| 74 | csUBP7_186C.20 (186C, I14A substitution mutant, signal peptide replaced with M and a GGSHHHHHH at C-terminus, and also comprising a C89A substitution) |
| 75 | csUBP7_186C.21 (186C, I14D substitution mutant, signal peptide replaced with M and a GGSHHHHHH at C-terminus, and also comprising a C89A substitution) |
| 76 | csUBP7_186C.22 (186C, I14E substitution mutant, signal peptide replaced with M and a GGSHHHHHH at C-terminus, and also comprising a C89A substitution) |
| 77 | csUBP7_186C.23 (186C, I14H substitution mutant, signal peptide replaced with M and a GGSHHHHHH at C-terminus, and also comprising a C89A substitution) |
| 78 | csUBP7_186C.24 (186C, I14T substitution mutant, signal peptide replaced with M and a GGSHHHHHH at C-terminus, and also comprising a C89A substitution) |
| 79 | csUBP7_186C.25 (186C, I14Y substitution mutant, signal peptide replaced with M and a GGSHHHHHH at C-terminus, and also comprising a C89A substitution) |
| 80 | csUBP7_186C.26 (186C, I14M substitution mutant, signal peptide replaced with M and a GGSHHHHHH at C-terminus, and also comprising a C89A substitution) |
| 81 | csUBP7_186C.27 (186C, I14L substitution mutant, signal peptide replaced with M and a GGSHHHHHH at C-terminus, and also comprising a C89A substitution) |
| 82 | csUBP7_186C.28 (186C, 211A substitution mutant, signal peptide replaced with M and a GGSHHHHHH at C-terminus, and also comprising a C89A substitution) |
| 83 | csUBP7_186C.29 (186C, 211Q substitution mutant, signal peptide replaced with M and a GGSHHHHHH at C-terminus, and also comprising a C89A substitution) |
| 84 | csUBP7_186C.30 (186C, 211S substitution mutant, signal peptide replaced with M and a GGSHHHHHH at C-terminus, and also comprising a C89A substitution) |
| 85 | csUBP7_186C.31 (186C, 211D substitution mutant, signal peptide replaced with M and a GGSHHHHHH at C-terminus, and also comprising a C89A substitution) |
| 86 | csUBP7_186C.32 (186C, 211E substitution mutant, signal peptide replaced with M and a GGSHHHHHH at C-terminus, and also comprising a C89A substitution) |
| 87 | csUBP7_186C.33 (186C, 211H substitution mutant, signal peptide replaced with M and a GGSHHHHHH at C-terminus, and also comprising a C89A substitution) |
| 88 | csUBP7_186C.34 (186C, 211T substitution mutant, signal peptide replaced with M and a GGSHHHHHH at C-terminus, and also comprising a C89A substitution) |
| 89 | csUBP7_186C.35 (186C, 211L substitution mutant, signal peptide replaced with M and a GGSHHHHHH at C-terminus, and also comprising a C89A substitution) |
| 90 | csUBP7_186C.36 (186C, 238A substitution mutant, signal peptide replaced with M and a GGSHHHHHH at C-terminus, and also comprising a C89A substitution) |

| SEQ ID NO | Sequence Name |
|---|---|
| 91 | csUBP7_186C.37 (186C, 238N substitution mutant, signal peptide replaced with M and a GGSHHHHHH at C-terminus, and also comprising a C89A substitution) |
| 92 | csUBP7_186C.38 (186C, 238Q substitution mutant, signal peptide replaced with M and a GGSHHHHHH at C-terminus, and also comprising a C89A substitution) |
| 93 | csUBP7_186C.39 (186C, 238H substitution mutant, signal peptide replaced with M and a GGSHHHHHH at C-terminus, and also comprising a C89A substitution) |
| 94 | csUBP7_26C_bZif (26C substitution mutant, with bZif fusion, signal peptide replaced with M and a GGSHHHHHH at C-terminus, and also comprising a C89A substitution) |
| 95 | csUBP7_27C_bZif (27C substitution mutant, with bZif fusion, signal peptide replaced with M and a GGSHHHHHH at C-terminus, and also comprising a C89A substitution) |
| 96 | csUBP7_30C_bZif (30C substitution mutant, with bZif fusion, signal peptide replaced with M and a GGSHHHHHH at C-terminus, and also comprising a C89A substitution) |
| 97 | csUBP7_95C_bZif (95C substitution mutant, with bZif fusion, signal peptide replaced with M and a GGSHHHHHH at C-terminus, and also comprising a C89A substitution) |
| 98 | csUBP7_186C.20_bZif (186C, 114A substitution mutant, with bZif fusion, signal peptide replaced with M and a GGSHHHHHH at C-terminus, and also comprising a C89A substitution) |
| 99 | csUBP7_186C.114A_Imm1 |
| 100 | csUBP7_186C.114A_Imm2 |
| 101 | csUBP7_186C.114A_Imm3 |
| 102 | csUBP7_186C.114A_Imm4 |
| 103 | csUBP7_186C.114A_Imm5 |
| 104 | csUBP7_186C.114A_Imm6 |
| 105 | βZif |
| 106 | ZF-QNK |
| 107 | Hexahistidine Tag |
| 108 | Hexalysine Tag |
| 109 | Exemplary nucleotide sequence encoding mpUBP1 |
| 110 | Exemplary nucleotide sequence encoding mhUBP2 |
| 111 | Exemplary nucleotide sequence encoding bsUBP3 |
| 112 | Exemplary nucleotide sequence encoding dcUBP4 |
| 113 | Exemplary nucleotide sequence encoding gtUBP5 |
| 114 | Exemplary nucleotide sequence encoding ctUBP6 |
| 115 | Exemplary nucleotide sequence encoding csUBP7 |
| 116 | Exemplary nucleotide sequence encoding taUBP8 |
| 117 | Exemplary nucleotide sequence encoding gkUBP10 |
| 118 | Exemplary nucleotide sequence encoding psUBP11 |
| 119 | Exemplary nucleotide sequence encoding teUBP12 |
| 120 | Exemplary nucleotide sequence encoding csUBP7_26C |
| 121 | Exemplary nucleotide sequence encoding csUBP7_27C |
| 122 | Exemplary nucleotide sequence encoding csUBP7_30C |
| 123 | Exemplary nucleotide sequence encoding csUBP7_65C |
| 124 | Exemplary nucleotide sequence encoding csUBP7_69C |
| 125 | Exemplary nucleotide sequence encoding csUBP7_90C |
| 126 | Exemplary nucleotide sequence encoding csUBP7_91C |
| 127 | Exemplary nucleotide sequence encoding csUBP7_92C |
| 128 | Exemplary nucleotide sequence encoding csUBP7_93C |
| 129 | Exemplary nucleotide sequence encoding csUBP7_95C |
| 130 | Exemplary nucleotide sequence encoding csUBP7_111C |
| 131 | Exemplary nucleotide sequence encoding csUBP7_114C |
| 132 | Exemplary nucleotide sequence encoding csUBP7_115C |
| 133 | Exemplary nucleotide sequence encoding csUBP7_116C |
| 134 | Exemplary nucleotide sequence encoding csUBP7_157C |
| 135 | Exemplary nucleotide sequence encoding csUBP7_158C |
| 136 | Exemplary nucleotide sequence encoding csUBP7_159C |
| 137 | Exemplary nucleotide sequence encoding csUBP7_186C |
| 138 | Exemplary nucleotide sequence encoding csUBP7_211C |
| 139 | Exemplary nucleotide sequence encoding csUBP7_238C |
| 140 | Exemplary nucleotide sequence encoding bsUBP3_76C |
| 141 | Exemplary nucleotide sequence encoding bsUBP3_77C |
| 142 | Exemplary nucleotide sequence encoding bsUBP3_78C |
| 143 | Exemplary nucleotide sequence encoding bsUBP3_79C |
| 144 | Exemplary nucleotide sequence encoding bsUBP3_145C |
| 145 | Exemplary nucleotide sequence encoding bsUBP3_172C |
| 146 | Exemplary nucleotide sequence encoding ctUBP6_95C |
| 147 | Exemplary nucleotide sequence encoding ctUBP6_96C |
| 148 | Exemplary nucleotide sequence encoding ctUBP6_97C |
| 149 | Exemplary nucleotide sequence encoding ctUBP6_98C |
| 150 | Exemplary nucleotide sequence encoding ctUBP6_164C |

| SEQ ID NO | Sequence Name |
|---|---|
| 151 | Exemplary nucleotide sequence encoding ctUBP6_191C |
| 152 | Exemplary nucleotide sequence encoding csUBP7_186C.1 |
| 153 | Exemplary nucleotide sequence encoding csUBP7_186C.2 |
| 154 | Exemplary nucleotide sequence encoding csUBP7_186C.3 |
| 155 | Exemplary nucleotide sequence encoding csUBP7_186C.4 |
| 156 | Exemplary nucleotide sequence encoding csUBP7_186C.5 |
| 157 | Exemplary nucleotide sequence encoding csUBP7_186C.6 |
| 158 | Exemplary nucleotide sequence encoding csUBP7_186C.7 |
| 159 | Exemplary nucleotide sequence encoding csUBP7_186C.8 |
| 160 | Exemplary nucleotide sequence encoding csUBP7_186C.9 |
| 161 | Exemplary nucleotide sequence encoding csUBP7_186C.10 |
| 162 | Exemplary nucleotide sequence encoding csUBP7_186C.11 |
| 163 | Exemplary nucleotide sequence encoding csUBP7_186C.12 |
| 164 | Exemplary nucleotide sequence encoding csUBP7_186C.13 |
| 165 | Exemplary nucleotide sequence encoding csUBP7_186C.14 |
| 166 | Exemplary nucleotide sequence encoding csUBP7_186C.15 |
| 167 | Exemplary nucleotide sequence encoding csUBP7_186C.16 |
| 168 | Exemplary nucleotide sequence encoding csUBP7_186C.17 |
| 169 | Exemplary nucleotide sequence encoding csUBP7_186C.18 |
| 170 | Exemplary nucleotide sequence encoding csUBP7_186C.19 |
| 171 | Exemplary nucleotide sequence encoding csUBP7_186C.20 |
| 172 | Exemplary nucleotide sequence encoding csUBP7_186C.21 |
| 173 | Exemplary nucleotide sequence encoding csUBP7_186C.22 |
| 174 | Exemplary nucleotide sequence encoding csUBP7_186C.23 |
| 175 | Exemplary nucleotide sequence encoding csUBP7_186C.24 |
| 176 | Exemplary nucleotide sequence encoding csUBP7_186C.25 |
| 177 | Exemplary nucleotide sequence encoding csUBP7_186C.26 |
| 178 | Exemplary nucleotide sequence encoding csUBP7_186C.27 |
| 179 | Exemplary nucleotide sequence encoding csUBP7_186C.28 |
| 180 | Exemplary nucleotide sequence encoding csUBP7_186C.29 |
| 181 | Exemplary nucleotide sequence encoding csUBP7_186C.30 |
| 182 | Exemplary nucleotide sequence encoding csUBP7_186C.31 |
| 183 | Exemplary nucleotide sequence encoding csUBP7_186C.32 |
| 184 | Exemplary nucleotide sequence encoding csUBP7_186C.33 |
| 185 | Exemplary nucleotide sequence encoding csUBP7_186C.34 |
| 186 | Exemplary nucleotide sequence encoding csUBP7_186C.35 |
| 187 | Exemplary nucleotide sequence encoding csUBP7_186C.36 |
| 188 | Exemplary nucleotide sequence encoding csUBP7_186C.37 |
| 189 | Exemplary nucleotide sequence encoding csUBP7_186C.38 |
| 190 | Exemplary nucleotide sequence encoding csUBP7_186C.39 |
| 191 | Exemplary nucleotide sequence encoding csUBP7_26C_bZif |
| 192 | Exemplary nucleotide sequence encoding csUBP7_27C_bZif |
| 193 | Exemplary nucleotide sequence encoding csUBP7_30C_bZif |
| 194 | Exemplary nucleotide sequence encoding csUBP7_95C_bZif |
| 195 | Exemplary nucleotide sequence encoding csUBP7_186C.20_bZif |
| 196 | Exemplary nucleotide sequence encoding csUBP7_186C.114A_Imm1 |
| 197 | Exemplary nucleotide sequence encoding csUBP7_186C.114A_Imm2 |
| 198 | Exemplary nucleotide sequence encoding csUBP7_186C.114A_Imm3 |
| 199 | Exemplary nucleotide sequence encoding csUBP7_186C.114A_Imm4 |
| 200 | Exemplary nucleotide sequence encoding csUBP7_186C.114A_Imm5 |
| 201 | Exemplary nucleotide sequence encoding csUBP7_186C.114A_Imm6 |
| 202 | paAmiC |
| 203 | TMXIS (conserved sequence) |
| 204 | XXXXN (conserved sequence) |
| 205 | ASXXXX (conserved sequence) |
| 206 | WTSXSRK (conserved sequence) |
| 207 | YPVQXEG (conserved sequence) |
| 208 | YVXPRTAX (conserved sequence) |
| 209 | PXGX (conserved sequence) |
| 210 | TXNGDXNV (conserved sequence) |
| 211 | SXXEXE (conserved sequence) |
| 212 | mpUBP1 (with signal peptide replaced with M and C75A, C385A, and C395A mutations) |
| 213 | mhUBP2 (with signal peptide replaced with M and C385A and C395A mutations) |
| 214 | bsUBP3 (with signal peptide replaced with M) |
| 215 | dcUBP4 (with signal peptide replaced with M) |
| 216 | gtUBP5 (with signal peptide replaced with M) |
| 217 | ctUBP6 (with signal peptide replaced with M) |
| 218 | csUBP7 (with signal peptide replaced with M and a C89A substitution) |
| 219 | taUBP8 (with signal peptide replaced with M and C141A and C402A substitutions) |
| 220 | gkUBP10 (with signal peptide replaced with M) |
| 221 | psUBP11 (with signal peptide replaced with M) |
| 222 | teUBP12 (with signal peptide replaced with MAND C185A, C216A, and C481A substitutions) |

| SEQ ID NO | Sequence Name |
|---|---|
| 223 | GGSHHHHHH |
| 224 | Flag-acidic-target-tag (FATT) hyperacidic region |
| 225 | ecGGBP (with signal peptide removed) |
| 226 | avUBP |
| 227 | cgUBP |
| 228 | LEVLFQGP (C3 protease recognition site) |
| 229 | ecTrx |
| 230 | Adaptor0 |
| 231 | Adaptor1.0 |
| 232 | Adaptor2.0a |
| 233 | Adaptor2.0b |
| 234 | Adaptor3.0 |
| 235 | Adaptor4.0 |
| 236 | Adaptor5.0 |
| 237 | Adaptor6.0 |
| 238 | Adaptor7.0 |
| 239 | Adaptor8.0 |
| 240 | Adaptor9.0 |
| 241 | Adaptor10.0 |
| 242 | Adaptor11.0 |
| 243 | Adaptor12.0 |
| 244 | Adaptor13.0 |
| 245 | Adaptor14.0 |
| 246 | Adaptor15.0 |
| 247 | Adaptor16.0 |

The terms "bZif" and "βZif" are used synonymously herein.

Exemplary amino acid sequences are listed below for convenience:

mpUBP1
(SEQ ID NO: 12)
MKVGVLHSLSGTMAISETTLKDTVLMMVEEQNKKGGLLGKKLEAVVVDPA

SNWPLFAEKARELLTEDQVDVIFGAWTSVSRKSVLPVIEELNGLMFYPVQ

YEGEESSYNVFYTGAAPNQQAIPAVNYLKDELGVERWVLAGTDYVYPRTT

NKILEAYLKDMGVAEDDIMINYTPFGHSDWQSIVSDIKKFGSAGKKTAVV

STINGDANVPFYKELGNQGISSEDIPVVAFSVGEEELSGLDTAPLVGHLA

AWNYFQSVETDENEEFITKWQAYTKNPERVTNDPMEATFIGFNMWANAVT

EAGTTDVDAVEKAMIGQETPNLTGGIAVMNKNHHLSKPVLIGEIQDDGQF

ETVWETDGVVPGDAWSDFLPGSKDLVADWTDPLKAGNYNTETKMASGQNY

GGSHHHHHH** mhUBP2
(SEQ ID NO: 13)
MKVGILHSLSGTMAISETALKDTMLMLIEKQNEAGGVLGRQLEPVVVDPA

SNWPLFAEKARELLEKEKVDVIFGNWTSVSRKSVLPVVEELNGLLFYPVQ

YEGEESSENVFYTGAAPNQQAIPAVDYLMNDLGVERWVLAGTDYVYPRTT

NKILETYLKDKGVAAGDIMINYTPFGHSDWQTIVSDIKKFGSAGKKTAVV

STINGDANVPFYRELGNQGISATDIPVVAFSVGEQELSGIDTAPLVGHLA

AWNYFMSVDNDANYDFIDAWVAYKGDDAAVTNDPMEAHYIGFNMYVEAVK

KAGTTDVDEVKDAIIGVSVPNLTGGYATMMPNHHITKPVLIGEIQDNGQF

SVVWETPSTVAGDAWSDFLPGSKDLISDWRAPLRAGNFNVVTGKAGGGSA

DVASNGGSHHHHHH** bsUBP3
(SEQ ID NO: 14)
MKVGILHSLSGTMAISEVSVHDAELIAIQEINQKGGVLGKKLEPVVEDGA

SDWPTYAEKMRKLLQQDKVAAVFGGWTSASRKAMLPVVEQNNGLLFYPVQ

YEGMETSPNIFYTGATTNQQIVPAVDWLLKNKGKKFFLIGSDYVFPRTAN

KIIKAQVKAGGGEIAGEEYTPLGHTNYSTLVSKIKEKQPDVIFNTLNGDS

NVAFFKQLKDAGISADDMPVMSASVAEEEIRGIGPDVLKGHYAVWNYFQT

TNTSENQTFVKNYKKMNGDSRVTSDPIEAGYNAVYLWAAAVEKAKSFDVD

KVKKAADGISFKAPGGTVKIDGDTQHLYKTVRIGQITGDGQFKEVWNSGE

PVKPDPYLKTYDWAKGLSKGGSHHHHHH** dcUBP4
(SEQ ID NO: 15)
MTIKVGILHSLSGTMAISEVSVKDAELMAIEEINASGGLLGKKIEPVIED

GASDWPTFAEKAKKLLQQDKVAVIFGGWTSASRKAMLPVVEENNGLLFYP

VQYEGLESSPNIFYTGAEPSQQIVPAVSWLLENRGKKFYLLGSDYVFPRT

ANKIIKAQLKAKGGEVVGEEYTPLGHTDYSTIINKIKAAKPEIIFNTLNG

DSNVAFFKQLKDAGITSKDITVMSVSIAEEEIRGIGPQNIAGHLAVWNYF

QTTDTPENKEFVKKFKTKYGQDRVTDDPIEAGYFGVYLWAEAVKKANSTD

VGKVKEAIKTVEFQAPEGLVKINGENQHTWKTVRIGEVQPDGQFKELWNS

GGPVKPDPYLKGYEWAKGLSNGGSHHHHHH** gtUBP5
(SEQ ID NO: 16)
MASSAVDEVKEKPKETSASETGDTVKVGILHSLSGTMAISEVSLRDAELM

AIEEINKSGGLLGKKIEPVIEDGASDWPTFAEKAKKLLQKDKVAAIFGGW

TSASRKAMLPVVEQNNGLLWYPVQYEGMESSPNIFYTGATTNQQIVPAVS

WLLENRGKRFFLLGSDYVFPRTANKIIKAQLKAEGGQLVGEEYTPLGHTD

```
YSTIINKIKEVKPDVVFNTLNGDSNVAFFKQLKDAGITAKDVTVMSVSIA
EEEIRGIGGDVLAGHLAVWNYFQSTDTPENKAFVEKYKKKYGKERVTDDP
IEAAYFAVHLWAEAVKKAGSFDVDKVKKAADGIEYKAPGGTVKIDGETQH
TWKIVRIGEIQANGQFKELWNSGKAVKPDPYLKSYPWAKNLNGGSHHHHH
H**
``` ctUBP6
                                  (SEQ ID NO: 17)
```
MVEEPVDNKPGTDTSAEDTIKVGILHSLSGTMAISEVSLKDAELMAIEEI
NQAGGLLGKKIEPVIEDGASDWPTFAEKAKKLLQNDKVATVFGCWTSASR
KAVLPVFEENNGLLWYPVQYEGMESSPNIFYTGAAPNQQIVPAVEWLLEN
KGKRFFLLGSDYVFPRTANKIIKAQLSAIGGELIAEEYTPLGHTDYSTIV
NKIKTAKPDVVFNTLNGDSNVAFFKQLKDAGITSEDITVCSVSVAEEEIR
GIGAENIKGHLVSWNYYQTTDTPENKEFVEKYKSKYGSDRVTDDPIEAAY
IAVHLWAEAVKKAGSFEVEKVKEAAKGLEFKAPEGLVKIEGENQHLWKPV
RIGEVQEDGLIKEIWSTSEAVRPDPYLKTYDWAKGLSDGGSHHHHHH**
``` csUBP7
                                  (SEQ ID NO: 18)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` taUBP8
                                  (SEQ ID NO: 19)
```
MKSGYANRRDFIKASAAVITLHTIAPALVWPSPKKIKVGVLHSLSGTMAI
SEVHVKNATLLAIEEINRKGGVLGYTIEPIIEDGASDPATFAQKAQKLIL
MDKVVTVFGGWTSASRKAMLPVFERYKNLLWYPVQFEGNEASPNIIYTGA
QPNQQILPALEWALKQGYKKFFLVGSDYVFPRTANLILKKHIQKNGAIVS
GEEYVPLGGTDFSAVVNKIINTKPDIVFNTINGDSNVAFFKQMAAAGVGP
KVLPVISFSIAEQEAKAIGIPLLEGSYAAWNYFMSLNNKANLEFIKAYQG
KYGKSSLITDPMAHGYMNVYLWKMAVEKAGTFDPMMVRKAATELPWVDSP
FGKIKIAKNQSLYQTAYIGKLGSDGQFSIVWSSGKPIEPEPYDKLVFPGK
KAVLGGSHHHHHH**
``` glcUBP10
                                  (SEQ ID NO: 20)
```
MAEESDNVDSADAEEDDSDVWWGGADTDYADGSEDKVVEVAEEEEVAEVE
EEEADDDEDDEDGDEVEEEAEEPYEEATERTTSIATTTTTTTESVEEVLE
VLFQGPASSAVDQAKNENKKDSSSASKEGDTVKVGILHSLSGTMAISEVS
LRDAELMAIEEINASGGLLGKKIEPVVEDGASDWPTFAEKAKKLLQKDQV
AAIFGGWTSASRKAMLPVVEQNNGLLWYPVQYEGMESSPNIFYTGATTNQ
QIVPAVSWLLKNRGKTFFLLGSDYVFPRTANKIIKAQLKAEGGQVVGEEY
TPLGHTDYSTIISKIKQVKPAVVFNTLNGDSNVAFFKQLKDAGITPKDVT
VMSVSIAEEEIRGIGPDVLAGHLAVWNYFQTTDTPENKAFVQKYKEKYGQ
DRVTDDPIEAAYTAVHLWAEAVKKAGSFDVDQVKKAAAGLEYKAPEGTVK
IDGETQHLWKTVRIGEIQADGQFKELWNSGQPVKPDPYLKSYPWAKGLSE
GGSHHHHHHHH**
``` psUBP11
                                  (SEQ ID NO: 21)
```
MAEESDNVDSADAEEDDSDVWWGGADTDYADGSEDKVVEVAEEEEVAEVE
EEEADDDEDDEDGDEVEEEAEEPYEEATERTTSIATTTTTTTESVEEVLE
VLFQGPKETAPTAGAGNGSPPVEAAGDSIKVGILHSLSGTMAISEVSVKD
AEMLAIEEINAAGGVLGKQIEPVIEDGASDWPTFAEKAGKLLQQDKVAAV
FGGWTSASRKAMLPVFEQNHGLLYPVQYEGLESSPNIFYTGATTNQQIV
PSVSWLLENRGKKMFLLGSDYVFPRTANKIIKAQLTAEGGELAGEEYTPL
GHTDFSTIIAKIKEAKPDIVYNTLNGDSNVAFFKQLKDAGTTSKDMTTLS
VSVAEEEIRGIGADILEGHLAAWNYYQSTDTPENKAFVDKYKAKYGADRV
TADPIEAGYTAVYLWKAAVEKAGTTDVDKVKEAAKGIEFAAPEGKVTIDG
DNQHIHKTVRIGEVQADGQFKELWNSGEPVKPDPYLKTYDWAKGLSGEGG
SHHHHHH**
``` teUBP12
                                  (SEQ ID NO: 22)
```
MAEESDNVDSADAEEDDSDVWWGGADTDYADGSEDKVVEVAEEEEVAEVE
EEEADDDEDDEDGDEVEEEAEEPYEEATERTTSIATTTTTTTESVEEVLE
VLFQGPGGDTIKVGILHSLSGTMAISEKSVVDATQLAIEQINQAGGVLGK
QIQPILEDGASDWPTFAEKATKLIDQDKVVAVFGAWTSASRKAVLPVFES
KNHMLWYPVQYEGQEASKNIFYTGAAPNQQIEPAVDWLLQNKGKKFFLVG
SDYVFPRTANTIIKQLAAKGGETVGEDYLPLGNTEVTPIITRIRNALPD
GGVIFNTLNGDSNVAFFKQLQGAGLTPDKYPTMSVSIAEEEVQAIGVEYL
KGHYAAWNYFMTVDTPENKSFVEAFKAKFGQNRVTNDPMEAAYIAVHLWK
QAVEQAGTADDLEKVRQAAIGQTFNAPEGPVKMFANHHISKTVRIGEVGE
DGLFKIVYSTPQPVDPLPWNQFVAETKGFAADWTRTDVDNPGKFKAAGAG
GSHHHHHH**
```

Cysteine Scans
csUBP7_26C
                                  (SEQ ID NO: 23)
```
MSSSESEKEKSEETIKVGILHSLSGCMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_27C
                                  (SEQ ID NO: 24)
```
MSSSESEKEKSEETIKVGILHSLSGTCSISEVSLKDAELMAIEEINNNGG
VLGKKLEPIVEDGASDWPTFAEKAKKLLQKDKVAVIFGAWTSASRKAVLP
```

-continued

VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_30C
(SEQ ID NO: 25)
MSSSESEKEKSEETIKVGILHSLSGTMSICEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_65C
(SEQ ID NO: 26)
MSSSESEKEKSEETIKVGILHSLSGTMSISEVSLKDAELMAIEEINNNGG
VLGKKLEPIVEDGACDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_69C
(SEQ ID NO: 27)
MSSSESEKEKSEETIKVGILHSLSGTMSISEVSLKDAELMAIEEINNNGG
VLGKKLEPIVEDGASDWPCFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_90C
(SEQ ID NO: 28)
MSSSESEKEKSEETIKVGILHSLSGTMSISEVSLKDAELMAIEEINNNGG
VLGKKLEPIVEDGASDWPTFAEKAKKLLQKDKVAVIFGACTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_91C
(SEQ ID NO: 29)
MSSSESEKEKSEETIKVGILHSLSGTMSISEVSLKDAELMAIEEINNNGG
VLGKKLEPIVEDGASDWPTFAEKAKKLLQKDKVAVIFGAWCSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_92C
(SEQ ID NO: 30)
MSSSESEKEKSEETIKVGILHSLSGTMSISEVSLKDAELMAIEEINNNGG
VLGKKLEPIVEDGASDWPTFAEKAKKLLQKDKVAVIFGAWTCASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_93C
(SEQ ID NO: 31)
MSSSESEKEKSEETIKVGILHSLSGTMSISEVSLKDAELMAIEEINNNGG
VLGKKLEPIVEDGASDWPTFAEKAKKLLQKDKVAVIFGAWTSCSRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_95C
(SEQ ID NO: 32)
MSSSESEKEKSEETIKVGILHSLSGTMSISEVSLKDAELMAIEEINNNGG
VLGKKLEPIVEDGASDWPTFAEKAKKLLQKDKVAVIFGAWTSASCKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_111C
(SEQ ID NO: 33)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP

```
VVEENNGLLFCPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_114C
                                            (SEQ ID NO: 34)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVCYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_115C
                                            (SEQ ID NO: 35)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQCEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_116C
                                            (SEQ ID NO: 36)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYCGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_157C
                                            (SEQ ID NO: 37)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDCVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_158C
                                            (SEQ ID NO: 38)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYCFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_159C
                                            (SEQ ID NO: 39)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVCPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_186C
                                            (SEQ ID NO: 40)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_211C
                                            (SEQ ID NO: 41)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLCGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH**
``` csUBP7_238C
                                            (SEQ ID NO: 42)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
```

VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVCIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** bsUBP3_76C
(SEQ ID NO: 43)
MKVGILHSLSGTMAISEVSVHDAELIAIQEINQKGGVLGKKLEPVVEDGA
SDWPTYAEKMRKLLQQDKVAAVFGGCTSASRKAMLPVVEQNNGLLFYPVQ
YEGMETSPNIFYTGATTNQQIVPAVDWLLKNKGKKFFLIGSDYVFPRTAN
KIIKAQVKAGGGEIAGEEYTPLGHTNYSTLVSKIKEKQPDVIFNTLNGDS
NVAFFKQLKDAGISADDMPVMSASVAEEEIRGIGPDVLKGHYAVWNYFQT
TNTSENQTFVKNYKKMNGDSRVTSDPIEAGYNAVYLWAAAVEKAKSFDVD
KVKKAADGISFKAPGGTVKIDGDTQHLYKTVRIGQITGDGQFKEVWNSGE
PVKPDPYLKTYDWAKGLSKGGSHHHHHH** bsUBP3_77C
(SEQ ID NO: 44)
MKVGILHSLSGTMAISEVSVHDAELIAIQEINQKGGVLGKKLEPVVEDGA
SDWPTYAEKMRKLLQQDKVAAVFGGWCSASRKAMLPVVEQNNGLLFYPVQ
YEGMETSPNIFYTGATTNQQIVPAVDWLLKNKGKKFFLIGSDYVFPRTAN
KIIKAQVKAGGGEIAGEEYTPLGHTNYSTLVSKIKEKQPDVIFNTLNGDS
NVAFFKQLKDAGISADDMPVMSASVAEEEIRGIGPDVLKGHYAVWNYFQT
TNTSENQTFVKNYKKMNGDSRVTSDPIEAGYNAVYLWAAAVEKAKSFDVD
KVKKAADGISFKAPGGTVKIDGDTQHLYKTVRIGQITGDGQFKEVWNSGE
PVKPDPYLKTYDWAKGLSKGGSHHHHHH** bsUBP3_78C
(SEQ ID NO: 45)
MKVGILHSLSGTMAISEVSVHDAELIAIQEINQKGGVLGKKLEPVVEDGA
SDWPTYAEKMRKLLQQDKVAAVFGGWTCASRKAMLPVVEQNNGLLFYPVQ
YEGMETSPNIFYTGATTNQQIVPAVDWLLKNKGKKFFLIGSDYVFPRTAN
KIIKAQVKAGGGEIAGEEYTPLGHTNYSTLVSKIKEKQPDVIFNTLNGDS
NVAFFKQLKDAGISADDMPVMSASVAEEEIRGIGPDVLKGHYAVWNYFQT
TNTSENQTFVKNYKKMNGDSRVTSDPIEAGYNAVYLWAAAVEKAKSFDVD
KVKKAADGISFKAPGGTVKIDGDTQHLYKTVRIGQITGDGQFKEVWNSGE
PVKPDPYLKTYDWAKGLSKGGSHHHHHH** bsUBP3_79C
(SEQ ID NO: 46)
MKVGILHSLSGTMAISEVSVHDAELIAIQEINQKGGVLGKKLEPVVEDGA
SDWPTYAEKMRKLLQQDKVAAVFGGWTSCSRKAMLPVVEQNNGLLFYPVQ
YEGMETSPNIFYTGATTNQQIVPAVDWLLKNKGKKFFLIGSDYVFPRTAN
KIIKAQVKAGGGEIAGEEYTPLGHTNYSTLVSKIKEKQPDVIFNTLNGDS
NVAFFKQLKDAGISADDMPVMSASVAEEEIRGIGPDVLKGHYAVWNYFQT
TNTSENQTFVKNYKKMNGDSRVTSDPIEAGYNAVYLWAAAVEKAKSFDVD
KVKKAADGISFKAPGGTVKIDGDTQHLYKTVRIGQITGDGQFKEVWNSGE
PVKPDPYLKTYDWAKGLSKGGSHHHHHH** bsUBP3_145C
(SEQ ID NO: 47)
MKVGILHSLSGTMAISEVSVHDAELIAIQEINQKGGVLGKKLEPVVEDGA
SDWPTYAEKMRKLLQQDKVAAVFGGWTSASRKAMLPVVEQNNGLLFYPVQ
YEGMETSPNIFYTGATTNQQIVPAVDWLLKNKGKKFFLIGSDYVCPRTAN
KIIKAQVKAGGGEIAGEEYTPLGHTNYSTLVSKIKEKQPDVIFNTLNGDS
NVAFFKQLKDAGISADDMPVMSASVAEEEIRGIGPDVLKGHYAVWNYFQT
TNTSENQTFVKNYKKMNGDSRVTSDPIEAGYNAVYLWAAAVEKAKSFDVD
KVKKAADGISFKAPGGTVKIDGDTQHLYKTVRIGQITGDGQFKEVWNSGE
PVKPDPYLKTYDWAKGLSKGGSHHHHHH** bsUBP3_172C
(SEQ ID NO: 48)
MKVGILHSLSGTMAISEVSVHDAELIAIQEINQKGGVLGKKLEPVVEDGA
SDWPTYAEKMRKLLQQDKVAAVFGGWTSASRKAMLPVVEQNNGLLFYPVQ
YEGMETSPNIFYTGATTNQQIVPAVDWLLKNKGKKFFLIGSDYVFPRTAN
KIIKAQVKAGGGEIAGEEYTPCGHTNYSTLVSKIKEKQPDVIFNTLNGDS
NVAFFKQLKDAGISADDMPVMSASVAEEEIRGIGPDVLKGHYAVWNYFQT
TNTSENQTFVKNYKKMNGDSRVTSDPIEAGYNAVYLWAAAVEKAKSFDVD
KVKKAADGISFKAPGGTVKIDGDTQHLYKTVRIGQITGDGQFKEVWNSGE
PVKPDPYLKTYDWAKGLSKGGSHHHHHH** ctUBP6_95C
(SEQ ID NO: 49)
MVEEPVDNKPGTDTSAEDTIKVGILHSLSGTMAISEVSLKDAELMAIEEI
NQAGGLLGKKIEPVIEDGASDWPTFAEKAKKLLQNDKVATVFGCCTSASR
KAVLPVFEENNGLLWYPVQYEGMESSPNIFYTGAAPNQQIVPAVEWLLEN
KGKRFFLLGSDYVFPRTANKIIKAQLSAIGGELIAEEYTPLGHTDYSTIV
NKIKTAKPDVVFNTLNGDSNVAFFKQLKDAGITSEDITVCSVSVAEEEIR
GIGAENIKGHLVSWNYYQTTDTPENKEFVEKYKSKYGSDRVTDDPIEAAY
IAVHLWAEAVKKAGSFEVEKVKEAAKGLEFKAPEGLVKIEGENQHLWKPV
RIGEVQEDGLIKEIWSTSEAVRPDPYLKTYDWAKGLSDGGSHHHHHH** ctUBP6_96C
(SEQ ID NO: 50)
MVEEPVDNKPGTDTSAEDTIKVGILHSLSGTMAISEVSLKDAELMAIEEI
NQAGGLLGKKIEPVIEDGASDWPTFAEKAKKLLQNDKVATVFGCWCSASR
KAVLPVFEENNGLLWYPVQYEGMESSPNIFYTGAAPNQQIVPAVEWLLEN
KGKRFFLLGSDYVFPRTANKIIKAQLSAIGGELIAEEYTPLGHTDYSTIV
NKIKTAKPDVVFNTLNGDSNVAFFKQLKDAGITSEDITVCSVSVAEEEIR
GIGAENIKGHLVSWNYYQTTDTPENKEFVEKYKSKYGSDRVTDDPIEAAY
IAVHLWAEAVKKAGSFEVEKVKEAAKGLEFKAPEGLVKIEGENQHLWKPV
RIGEVQEDGLIKEIWSTSEAVRPDPYLKTYDWAKGLSDGGSHHHHHH** ctUBP6_97C
(SEQ ID NO: 51)
MVEEPVDNKPGTDTSAEDTIKVGILHSLSGTMAISEVSLKDAELMAIEEI
NQAGGLLGKKIEPVIEDGASDWPTFAEKAKKLLQNDKVATVFGCWTCASR

KAVLPVFEENNGLLWYPVQYEGMESSPNIFYTGAAPNQQIVPAVEWLLEN

KGKRFFLLGSDYVFPRTANKIIKAQLSAIGGELIAEEYTPLGHTDYSTIV

NKIKTAKPDVVFNTLNGDSNVAFFKQLKDAGITSEDITVCSVSVAEEEIR

GIGAENIKGHLVSWNYYQTTDTPENKEFVEKYKSKYGSDRVTDDPIEAAY

IAVHLWAEAVKKAGSFEVEKVKEAAKGLEFKAPEGLVKIEGENQHLWKPV

RIGEVQEDGLIKEIWSTSEAVRPDPYLKTYDWAKGLSDGGSHHHHHH** ctUBP6_98C (SEQ ID NO: 52)
MVEEPVDNKPGTDTSAEDTIKVGILHSLSGTMAISEVSLKDAELMAIEEI

NQAGGLLGKKIEPVIEDGASDWPTFAEKAKKLLQNDKVATVFGCWTSCSR

KAVLPVFEENNGLLWYPVQYEGMESSPNIFYTGAAPNQQIVPAVEWLLEN

KGKRFFLLGSDYVFPRTANKIIKAQLSAIGGELIAEEYTPLGHTDYSTIV

NKIKTAKPDVVFNTLNGDSNVAFFKQLKDAGITSEDITVCSVSVAEEEIR

GIGAENIKGHLVSWNYYQTTDTPENKEFVEKYKSKYGSDRVTDDPIEAAY

IAVHLWAEAVKKAGSFEVEKVKEAAKGLEFKAPEGLVKIEGENQHLWKPV

RIGEVQEDGLIKEIWSTSEAVRPDPYLKTYDWAKGLSDGGSHHHHHH** ctUBP6_164C (SEQ ID NO: 53)
MVEEPVDNKPGTDTSAEDTIKVGILHSLSGTMAISEVSLKDAELMAIEEI

NQAGGLLGKKIEPVIEDGASDWPTFAEKAKKLLQNDKVATVFGCWTSASR

KAVLPVFEENNGLLWYPVQYEGMESSPNIFYTGAAPNQQIVPAVEWLLEN

KGKRFFLLGSDYVCPRTANKIIKAQLSAIGGELIAEEYTPLGHTDYSTIV

NKIKTAKPDVVFNTLNGDSNVAFFKQLKDAGITSEDITVCSVSVAEEEIR

GIGAENIKGHLVSWNYYQTTDTPENKEFVEKYKSKYGSDRVTDDPIEAAY

IAVHLWAEAVKKAGSFEVEKVKEAAKGLEFKAPEGLVKIEGENQHLWKPV

RIGEVQEDGLIKEIWSTSEAVRPDPYLKTYDWAKGLSDGGSHHHHHH** ctUBP6_191C (SEQ ID NO: 54)
MVEEPVDNKPGTDTSAEDTIKVGILHSLSGTMAISEVSLKDAELMAIEEI

NQAGGLLGKKIEPVIEDGASDWPTFAEKAKKLLQNDKVATVFGCWTSASR

KAVLPVFEENNGLLWYPVQYEGMESSPNIFYTGAAPNQQIVPAVEWLLEN

KGKRFFLLGSDYVFPRTANKIIKAQLSAIGGELIAEEYTPCGHTDYSTIV

NKIKTAKPDVVFNTLNGDSNVAFFKQLKDAGITSEDITVCSVSVAEEEIR

GIGAENIKGHLVSWNYYQTTDTPENKEFVEKYKSKYGSDRVTDDPIEAAY

IAVHLWAEAVKKAGSFEVEKVKEAAKGLEFKAPEGLVKIEGENQHLWKPV

RIGEVQEDGLIKEIWSTSEAVRPDPYLKTYDWAKGLSDGGSHHHHHH** csUBP7 186C Affinity Tuning
csUBP7_186C.1

(SEQ ID NO: 55)
MSSSESEKEKSEETIKVGILHSLSGTMSISEVSLKDAELMAIQEINNNGG

VLGKKLEPIVEDGASDWPTFAEKAKKLLQKDKVAVIFGAWTSASRKAVLP

VVEENNGLLFYPVQYEGLESSPNIFYMGAAPNQQIVPAVKWLFDNGKKRF

YLLGSDYVFPRTANKIIKAYLKYLGGVVVGEEYTPCGHTDYSSVINKIKA

AKPDVVFNTLNGDSNVAFFKQLKDAGIDANTLPVMSVSIAEEEIKGIGPE

YLKGHLVTWNYFQSVDTPENKEFVENYKKMYGEDRVTDDPIEAAYIGVYL

WAKAVEKAGSTDVDKVREAAKGIEFNAPEGPVKIDGDNQHLYKTVRIGEI

LENGQIRELWKTNKPVKPDPYLKGYEWAQGLSEQGGSHHHHHH** csUBP7_186C.2

(SEQ ID NO: 56)
MSSSESEKEKSEETIKVGILHSLSGTMSISEVSLKDAELMAIEEINNNGG

VLGKKLEPIVEDGASDWPTFAEKAKKLLQKDKVAVIFGAWTSASRKAVLP

VVEENNGLLFYPVQYEGLESSPNIFYMGAAPNQQIVPAVKWLFDNGKKRF

YLLGSDYVFPRTANKIIKAYLKYLGGVVVGEEYTPCGHTDYSSVINKIKA

AKPDVVFNTLNGDSNVAFFKQLKDAGIDANTLPVMSVSIAEEEIKGIGPE

YLKGHLVTWNYFQSVDTPENKEFVEKYKKKYGEDRVTSDPIEAAYIGVYL

WAKAVEKAGSTDVDKVREAAKGIEFNAPEGPVKIDGDNQHLYKTVRIGEI

LENGQIRELWKTNKPVKPDPYLKGYEWAQGLSEQGGSHHHHHH** csUBP7_186C.3

(SEQ ID NO: 57)
MSSSESEKEKSEETIKVGILHSLSGTMSISEVSLKDAELMAIEEINNNGG

VLGKKLEPIVEDGASDWPTFAEKAKKLLQKDKVAVIFGAWTSASRKAVLP

VVEENNGLLFYPVQYEGLESSPNIFYMGAAPNQQIVPAVKWLFDNGKKRF

YLLGSDYVFPRTANKIIKAYLKYLGGVVVGEEYTPCGHTDYSSVINKIKA

AKPDVVFNTLNGDSNVAFFKQLKDAGIDANTLPVMSVSIAEEEIKGIGPE

YLKGHLVTWNYFQSVDTPENKEFVEKYKKKYGEDRVTDDPIEAAYIGVYL

WAKAVEKAGSTDVDKVREAAKGIEFNAPGGPVKIDGDNQHLYKTVRIGEI

LENGQIRELWKTNKPVKPDPYLKGYEWAQGLSEQGGSHHHHHH** csUBP7_186C.4

(SEQ ID NO: 58)
MSSSESEKEKSEETIKVGILHSLSGTMSISEVSLKDAELMAIEEINNNGG

VLGKKLEPIVEDGASDWPTFAEKAKKLLQKDKVAVIFGAWTSASRKAVLP

VVEENNGLLFYPVQYQGLESSPNIFYMGAAPNQQIVPAVKWLFDNGKKRF

YLLGSDYVFPRTANKIIKAYLKYLGGVVVGEEYTPCGHTDYSSVINKIKA

AKPDVVFNTLNGDSNVAFFKQLKDAGIDANTLPVMSVSIAEEEIKGIGPE

YLKGHLVTWNYFQSVDTPENKEFVEKYKKKYGEDRVTDDPIEAAYIGVYL

WAKAVEKAGSTDVDKVREAAKGIEFNAPEGPVKIDGDNQHLYKTVRIGEI

LENGQIRELWKTNKPVKPDPYLKGYEWAQGLSEQGGSHHHHHH** csUBP7_186C.5

(SEQ ID NO: 59)
MSSSESEKEKSEETIKVGILHSLSGTMSISEVSLKDAELMAIEEINNNGG

VLGKKLEPIVEDGASDWPTFAEKAKKLLQKDKVAVIFGAWTSASRKAVLP

VVEENNGLLFYPVQYDGLESSPNIFYMGAAPNQQIVPAVKWLFDNGKKRF

YLLGSDYVFPRTANKIIKAYLKYLGGVVVGEEYTPCGHTDYSSVINKIKA

AKPDVVFNTLNGDSNVAFFKQLKDAGIDANTLPVMSVSIAEEEIKGIGPE

YLKGHLVTWNYFQSVDTPENKEFVEKYKKKYGEDRVTDDPIEAAYIGVYL

WAKAVEKAGSTDVDKVREAAKGIEFNAPEGPVKIDGDNQHLYKTVRIGEI

LENGQIRELWKTNKPVKPDPYLKGYEWAQGLSEQGGSHHHHHH** csUBP7_186C.6
(SEQ ID NO: 60)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYAGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.7
(SEQ ID NO: 61)
MSSSESEKEKSEETIKVGILHSLSGTMSIIEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.8
(SEQ ID NO: 62)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.9
(SEQ ID NO: 63)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVSYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.10
(SEQ ID NO: 64)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVNYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.11
(SEQ ID NO: 65)
MSSSESEKEKSEETIKVGILHSLSGTMSISEVSLKDAELMAIEEINNNGG
VLGKKLEPIVEDGASDWPTFAEKAKKLLQKDKVAVIFGAWTAASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.12
(SEQ ID NO: 66)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFAPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.13
(SEQ ID NO: 67)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDAVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.14
(SEQ ID NO: 68)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVAPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.15
(SEQ ID NO: 69)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPAQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.16
(SEQ ID NO: 70)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPTQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.17
(SEQ ID NO: 71)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPNQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.18
(SEQ ID NO: 72)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPQQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.19
(SEQ ID NO: 73)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPHQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.20
(SEQ ID NO: 74)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVAYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.21
(SEQ ID NO: 75)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVDYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.22
(SEQ ID NO: 76)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVEYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.23
(SEQ ID NO: 77)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVHYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.24
(SEQ ID NO: 78)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVTYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.25
(SEQ ID NO: 79)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVYYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.26
(SEQ ID NO: 80)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVMYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.27
(SEQ ID NO: 81)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVLYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.28
(SEQ ID NO: 82)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLAGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.29
(SEQ ID NO: 83)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLQGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.30
(SEQ ID NO: 84)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLSGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.31
(SEQ ID NO: 85)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLDGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.32
(SEQ ID NO: 86)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLEGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.33
(SEQ ID NO: 87)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLHGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.34
(SEQ ID NO: 88)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLTGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.35
(SEQ ID NO: 89)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLLGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.36
(SEQ ID NO: 90)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVAIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.37
(SEQ ID NO: 91)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVNIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.38
(SEQ ID NO: 92)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVQIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7_186C.39
(SEQ ID NO: 93)
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVHIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHH** csUBP7 C-terminal bZif Constructs
csUBP7_26C_bZif
(SEQ ID NO: 94)
MSSSESEKEKSEETIKVGILHSLSGCMSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSGGSTGEKPYKCPE
CGKSFSRSGGSHHHHHH** csUBP7_27C_bZif
(SEQ ID NO: 95)
MSSSESEKEKSEETIKVGILHSLSGTCSISEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL

```
WAKAVEKAGSTDVDKVREAAKGIEFNAPEGPVKIDGDNQHLYKTVRIGEI
LENGQIRELWKTNKPVKPDPYLKGYEWAQGLSEQGGSGGSTGEKPYKCPE
CGKSFSRSGGSHHHHHH**
``` csUBP7_30C_bZif
(SEQ ID NO: 96)
```
MSSSESEKEKSEETIKVGILHSLSGTMSICEVSLKDAELMAIEEINNNGG
VLGKKLEPIVEDGASDWPTFAEKAKKLLQKDKVAVIFGAWTSASRKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSGGSTGEKPYKCPE
CGKSFSRSGGSHHHHHH**
``` csUBP7_95C_bZif
(SEQ ID NO: 97)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASCKAVLP
VVEENNGLLFYPVQYEGLESSPNIFYMGAAPNQQIVPAVKWLFDNGKKRF
YLLGSDYVFPRTANKIIKAYLKYLGGVVVGEEYTPLGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSGGSTGEKPYKCPE
CGKSFSRSGGSHHHHHH**
``` csUBP7_186C_20_bZif
(SEQ ID NO: 98)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVAYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSGGSTGEKPYKCPE
CGKSFSRSGGSHHHHHH**
``` csUBP7 Immobilization Constructs
csUBP7_186C.114A_Imm1
(SEQ ID NO: 99)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVAYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSKKKKKKGGSHHHH
HH**
``` csUBP7_186C.114A_Imm2
(SEQ ID NO: 100)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVAYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHGGSKKKK
KK**
``` csUBP7_186C.114A_Imm3
(SEQ ID NO: 101)
```
MSSSESEKEKSEETIKVGILHSLSGTMSISEVSLKDAELMAIEEINNNGG
VLGKKLEPIVEDGASDWPTFAEKAKKLLQKDKVAVIFGAWTSASRKAVLP
VVEENNGLLFYPVAYEGLESSPNIFYMGAAPNQQIVPAVKWLFDNGKKRF
YLLGSDYVFPRTANKIIKAYLKYLGGVVVGEEYTPCGHTDYSSVINKIKA
AKPDVVFNTLNGDSNVAFFKQLKDAGIDANTLPVMSVSIAEEEIKGIGPE
YLKGHLVTWNYFQSVDTPENKEFVEKYKKKYGEDRVTDDPIEAAYIGVYL
WAKAVEKAGSTDVDKVREAAKGIEFNAPEGPVKIDGDNQHLYKTVRIGEI
LENGQIRELWKTNKPVKPDPYLKGYEWAQGLSEQGGSHHHHHGGSKKKK
KKKKKK**
``` csUBP7_186C.114A_Imm4
(SEQ ID NO: 102)
```
MKKKKKKGGSSSESEKEKSEETIKVGILHSLSGTMSISEVSLKDAELMAI
EEINNNGGVLGKKLEPIVEDGASDWPTFAEKAKKLLQKDKVAVIFGAWTS
ASRKAVLPVVEENNGLLFYPVAYEGLESSPNIFYMGAAPNQQIVPAVKWL
FDNGKKRFYLLGSDYVFPRTANKIIKAYLKYLGGVVVGEEYTPCGHTDYS
SVINKIKAAKPDVVFNTLNGDSNVAFFKQLKDAGIDANTLPVMSVSIAEE
EIKGIGPEYLKGHLVTWNYFQSVDTPENKEFVEKYKKKYGEDRVTDDPIE
AAYIGVYLWAKAVEKAGSTDVDKVREAAKGIEFNAPEGPVKIDGDNQHLY
KTVRIGEILENGQIRELWKTNKPVKPDPYLKGYEWAQGLSEQGGSHHHHH
H**
``` csUBP7_186C.114A_Imm5
(SEQ ID NO: 103)
```
MKKKKKKKKKKGGSSSESEKEKSEETIKVGILHSLSGTMSISEVSLKDAE
LMAIEEINNNGGVLGKKLEPIVEDGASDWPTFAEKAKKLLQKDKVAVIFG
AWTSASRKAVLPVVEENNGLLFYPVAYEGLESSPNIFYMGAAPNQQIVPA
VKWLFDNGKKRFYLLGSDYVFPRTANKIIKAYLKYLGGVVVGEEYTPCGH
TDYSSVINKIKAAKPDVVFNTLNGDSNVAFFKQLKDAGIDANTLPVMSVS
```

```
IAEEEIKGIGPEYLKGHLVTWNYFQSVDTPENKEFVEKYKKKYGEDRVTD

DPIEAAYIGVYLWAKAVEKAGSTDVDKVREAAKGIEFNAPEGPVKIDGDN

QHLYKTVRIGEILENGQIRELWKTNKPVKPDPYLKGYEWAQGLSEQGGSH

HHHHH** csUBP7_186C.114A_Imm6
                                            (SEQ ID NO: 104)
MSSSESEKEKSEETIKVGILHSLSGTMSISEVSLKDAELMAIEEINNNGG

VLGKKLEPIVEDGASDWPTFAEKAKKLLQKDKVAVIFGAWTSASRKAVLP

VVEENNGLLFYPVAYEGLESSPNIFYMGAAPNQQIVPAVKWLFDNGKKRF

YLLGSDYVFPRTANKIIKAYLKYLGGVVVGEEYTPCGHTDYSSVINKIKA

AKPDVVFNTLNGDSNVAFFKQLKDAGIDANTLPVMSVSIAEEEIKGIGPE

YLKGHLVTWNYFQSVDTPENKEFVEKYKKKYGEDRVTDDPIEAAYIGVYL

WAKAVEKAGSTDVDKVREAAKGIEFNAPEGPVKIDGDNQHLYKTVRIGEI

LENGQIRELWKTNKPVKPDPYLKGYEWAQGLSEQGGSGGSTGEKPYKCPE

CGKSFSRSDHLSRHQRTHQNKKGGSHHHHHH**
```

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only, since alternative methods can be utilized to obtain similar results.

Example 1

Exemplary Fluorescently Responsive Sensor Engineering Phases

The engineering of FRSs can be divided into six phases:
1. Binding protein discovery. A set of binding protein sequence homologs is identified. Accurate assignment of their urea-binding function requires combining genomic contextual and three-dimensional protein structural information.
2. Experimental lead validation. Synthetic genes are constructed, which are optimized for heterologous expression in *Escherichia coli* of one or more predicted urea-binding protein sequences. The urea-binding properties and thermostabilities of the corresponding expressed, purified proteins are evaluated.
3. Determination of the three-dimensional structure of an analyte-binding protein. High-resolution X-ray crystallography is used to determine the three-dimensional structure of a representative urea-binding protein identified in step 2. This structure is used for execution of the next two phases.
4. Engineering of fluorescent responses. Semisynthetic fluorescent conjugates of the experimentally validated leads are constructed by first attaching single fluorophores to single cysteine mutants. The effect of urea binding on the fluorescence emission properties of those conjugates is evaluated. The spectral properties of a subset of responsive fluorophores is improved using a double-labeling strategy in which a second fluorophore is site-specifically attached to a small domain fused to the N- or C-terminus to establish ngmFRET. Those singly or doubly labeled conjugates that evince strong, ratiometric responses are selected as FRSs for use in sensing applications.
5. Affinity tuning. Single or multiple mutations are introduced by site-directed mutagenesis to alter the urea-binding affinities of urea-responsive FRSs. A set of FRS variants is selected from a collection of affinity-tuned FRSs that spans almost four orders of magnitude (from 60 µM to 180 mM), suitable for accurately measuring urea concentrations in clinical [e.g. (less than about 2 mM), within (about 2 mM to about 7 mM), or above (greater than about 7 mM) the normal range of human blood] or environmental (e.g., from 60 µM to 180 mM) samples.
6. Device integration. FRSs are immobilized in the sampling component of the analytical device in a manner that preserves their fluorescent response and urea affinity. Long-term storage conditions are established.

Example 2

Sensor Engineering Phase 1: Identification of a Family of Periplasmic Urea-Binding Proteins Homologs Using Structurally Assisted Function Evaluation Accurately assigning function to sequence homologs is a challenging task, especially when the degree of identity with the seed sequence of known biological function is low (Todd, 2001, *J. Mol. Biol.*, 307, 1113-1143; Tian, 2003, *J. Mol. Biol.*, 333, 863-882), e.g., less than 60% identity as determined by BLAST having the following parameters: (1) Expect threshold is 10.0; (2) Gap cost is Existence:11 and Extension:1; (3) The Matrix employed is BLOSUM62; (4) The filter for low complexity regions is "on." The diversity of ligands recognized by the PBP superfamily make this task especially difficult, as evidenced by the observation that related members in a clade or family can recognize chemically quite distinct molecules (Cuneo, Beese and Hellinga, 2009, *J Biol Chem*, 284, 33217-23; Nanavati, 2006, *Appl. Environ. Microbiol.*, 72, 1336-1345).

The use of protein three-dimensional structural information provides a particularly powerful method for the accurate assignment of function. For instance, enzyme functional assignments are improved greatly if a sequence selection filter based on conservation of catalytic residues identified from protein structures is included. Such catalytic residues comprise a subset of all the residues that contact an enzyme substrate or inhibitor. In the case of the PBPs, functional selection filters need be even more stringent and take into account all the protein-ligand contacts that encode the entire ligand-recognition surface. Accordingly, we have developed a structurally assisted functional evaluation (SAFE) method to identify PBP sequence homologs with accurately predicted function. The SAFE homolog search method consists of five steps:
1. Sequence homolog set is collected using the BLAST sequence alignment tool (Altschul et al., 1990, *J Mol Biol*, 215, 403-10), starting with the sequence of a protein of known structure that encodes either the desired, or a closely related function. The following BLAST parameters: (1) Expect threshold is 10.0; (2) Gap cost is Existence:11 and Extension:1; (3) The Matrix employed is BLOSUM62; (4) The filter for low complexity regions is "on." Permissive settings are used, such that pairwise hits are required to have a minimum of only 20-25% sequence identity with the seed sequence. The lengths of the hit and seed are mutually constrained such that the alignment covers at least 70% within each partner. This set of sequences defines possible analyte-binding proteins without accurately assigning function.

2. Structure-based encoding of biological function. A primary complementary surface comprising the protein residues that form hydrogen bonds and van der Waals contacts with the bound analyte or related analyte-related molecule is defined using computer-assisted, visual inspection of the three-dimensional structure. This definition specifies residue positions and their permitted amino acid identity. Multiple amino acid identities are permitted at each position to encode functionally equivalent residues. This definition establishes a search filter for the accurate prediction of analyte-binding proteins within the universe of sequence homologs collected in Step (1).
3. Accurate sequence alignment. Tools such as ClustalW (Chenna et al., 2003, *Nucleic Acids Res,* 31, 3497-500) are used to construct an accurate alignment of all the sequence homologs. The structurally defined seed sequence is included in this alignment. This multiple sequence alignment establishes the equivalent residue positions of the PCS in each sequence homolog.
4. Function evaluation. The analyte-binding properties of each of the aligned sequence homologs is predicted by measuring their compliance of amino acid residue identity at each position within the PCS filter. A "Hamming distance", H, is assigned for each homolog, which specifies the degree of sequence identity of all the residues at the aligned PCS positions. A value of H=0 indicates that the identities of all the residues at the aligned PCS positions match the amino acid(s) allowed in the PCS search filter; H>0, indicates that one or more aligned positions have disallowed residues. Sequences for which H=0 are predicted to encode analyte-binding proteins.
5. Selection of representative SAFE homologs. The sequence homologs are ordered by (a) identity with the seed PCS, as measured by the Hamming distance, (b) fractional overall sequence identity with the seed sequence. A subset for sequences with H=0, sampling the fractional overall sequence identity is selected for experimental verification.

These steps are encoded in the ProteinHunter software tool, which encodes the flow of execution, applies the PCS search filter, and visualizes the results, and handles organism annotations such as thermophilicity, and Gram stain status.

The ProteinHunter package always executes BLAST searches, with the following command "blastall -p blastp -m 8 -b 50000 -d %s -i <INPUT FILE> -o <OUTPUT FILE>"

where <INPUT FILE> and <OUTPUT FILE> specify the input and output files, respectively for a given calculation. This command executes the BLAST alignment program for protein sequences with default parameters, intrinsically set by the program. The BLAST program version is 2.2.24.

The ProteinHunter package always executes multiple sequence alignments with the following command "clustalw -infile=<INPUT FILE> -outfile=<OUTPUTFILE> -align -quiet"

This command executes the CLUSTALW multi-sequence alignment program for protein sequences. There are no user-specified parameter settings that alter the alignment behavior of the program. The CLUSTALW program version is 2.1.

Prior to the work reported here, no periplasmic urea-binding proteins (UBPs) had been characterized structurally. Accordingly, before we could apply the SAFE search procedure, we had to use experimentally verified UBP sequences to identify a structurally defined sequence homolog that binds a related ligand. Operons encoding ABC transporter systems for urea (urtABCDE) have been genotypically and phenotypically identified in *Anabaena* sp. (avUBP), *Synechocystis* sp. (spUBP), and *Corynebacterium glutamicum* (cgUBP). The sequence of their soluble periplasmic-binding component (urtA) was used to identify homologs in the Protein Databank, using the 'ProteinHunter' software package (*A. variabilis* sequence taken from GenBank genome sequence NC_007413, protein ID YP_324854.1; *C. glutamicum*: genome NC_022040, protein YP_008401061.1). This search strategy identified a moderate degree of sequence homology with the *Pseudomonas aeruginosa* AmiC negative regulator of the amiEBCDRS amidase operon (paAmiC, PDB accession, 1pea): avUBP, 31.8% identity; cgUBP, 29.8% identity. The structure of the paAmiC acetamide complex defines a PCS filter for acetamide, a ligand that is closely related to urea (FIGS. 2A and B, 3 and Table 1). The sequence of paAmiC is as follows:

(SEQ ID NO: 202)
```
MGSHQERPLIGLLFSETGVTADIERSQRYGALLAVEQLNREGGVGGRPIE
TLSQDPGGDPDRYRLCAEDFIRNRGVRFLVGCYMSHTRKAVMPVVERADA
LLCYPTPYEGFEYSPNIVYGGPAPNQNSAPLAAYLIRHYGERVVFIGSDY
IYPRESNHVMRHLYRQHGGTVLEEIYIPLYPSDDDLQRAVERIYQARADV
VFSTVVGTGTAELYRAIARRYGDGRRPPIASLTTSEAEVAKMESDVAEGQ
VVVAPYFSSIDTPASRAFVQACHGFFPENATITAWAEAAYWQTLLLGRAA
QAAGNWRVEDVQRHLYDIDIDAPQGPVRVERQNNHSRLSSRIAEIDARGV
FQVRWQSPEPIRPDPYVVVHNLDDWSASMGGGPLP
```

The sequence of avUBP is as follows:

(SEQ ID NO: 226)
```
MSRRINRRRFLIYGSATIGSSILLKACANNTPNATNSPSTSGNASPVAAS
GGNTIKIGILHSLSGTMSISEKSVVDAEKLAIKEINAAGGVLGKQIEAIV
EDGASNWDTFREKATKLIDQDKVAVVFGCWTSASRKNVKPVFESKDHMLW
YPVQYEGQECSKNIFYTGAAPNQQIEPSVDWLLKNKGKEFFLVGSDYVFP
RTANTIIKAQLEALGGKTVGEDYLPLGNTEVTPIITKIKQTLPNGGVIYN
TLNGDSNVAFFKQLKGAGLTPDKYPSMSVSIAEEEVKAIGVEYLKGHYAA
WNYFQTVDTPANKKFVEAFKKEYGADRVTNDPMEAAYIAVYLWKQAVEKA
GSPDLAKVRAAAYGQTIDAPEGKVTVNANHHISKVVRIGEVRDDGLFDIV
YATPAPVEPVPWNQFVKETKGFACDWSDPAKGGKYKKA
```

The sequence of cgUBP is as follows:

(SEQ ID NO: 227)
```
MSRPIVKQAFTVTAVTAMAFALASCTRAVDATSADGTASNTAASCVDTSG
DSIKIGFINSLSGTMAISETTVNQSLHMAADEINAAGGVLGKQLEISEED
GASEPATFAERSQRLIQQECVAAVFGGWTSASRKAMLPVFEGNNSLLFYP
VQYEGMESSPNIFYTGATTNQQIIPALDYLRENGLNRLFLVGSDYVFPRT
ANSIIKDYAEANGMEIVGEDYAPLGSTDFTTIANRMRDSNADAVFNTLNG
DSNVAFFRQYNSLGFNADTLPVMSVSIAEEEVGGIGTANIEGQLVAWDYY
QTIDTPENETFVENFKDLYGQDKVTSDPMEAAYTSLYLWKEMVEKADSFD
VAAIQAAADGTTFDAPEGTVVVDGDNHHISKTPRIGRIRPDGLIDTIWET
DSPVDPDPYLSSYDWAKTTAATS
```

TABLE 1

Residues that form the primary complementary surface in paAmiC and in the putative UreaBP PCS filter.

| | paAmiC | | UreaBP PCS filter | |
|---|---|---|---|---|
| Position | Identity | Interaction | Identity | Interaction |
| 85 | S | Hydrogen bond to amine | S | Same |
| 104 | Y | Hydrogen bond to amine | Y | Same |
| 106 | T | Van der Waals contact | V | Same |
| 107 | P | Main-chain carbonyl hydrogen bond to amine | Q | Hydrogen bond to amine |
| 150 | Y | Hydrogen bond to carbonyl | Y | Same |
| 152 | Y | Ring forms extensive van der Waals contact | Y, F | Same |
| 206 | V | Secondary shell | N | Hydrogen bond to amine |
| 233 | T | Van der Waals contact with methyl | S | Hydrogen bond to amine |

Next, we needed to establish the likely PCS filter that encodes recognition of urea instead of acetamide. To achieve this objective, genomic contextual information was used to identify a subset of sequences homologous to paAmiC, which that are likely to encode urea—rather than acetamide—binding proteins. To deduce a likely urea-binding PCS using information from this subset, we examined the identity of the PCS residues within its members.

As a first step in this procedure, the paAmiC sequence was used to identify a set of sequence homologs with at least 25% residue identity within a database of complete prokaryotic genome sequences. The database was constructed from the annotated genomic and plasmid sequences of 5062 prokaryotes obtained from the National Center of Biotechnology Information (ftp://ftp.ncbi.nih.gov/genomes/Bacteria/all.gbk.tar.gz). The protein sequence for paAmiC was extracted from the protein structure file 1pea (Pearl 1994 EMBO J., 13, 5810-5817; O'Hara 1999 EMBO J., 18, 5175-5186) and used as the seed sequence for the BLAST search described above (Table 2, line 1). We also constructed homolog sets for avUBP and cgUBP, using a minimum of 25% identity threshold (Table 2, lines 2 and 3). We then constructed a set comprising the intersection of the paAmiC, avUBP, and cgUBP homolog families (Table 2, line 4). This 'combined set' is intended to enrich for UBPs by ruling out sequences that cannot be identified by all three seeds.

TABLE 2

Operon linkage relationships$^a$.

| | | | Operon membership | | | | | Outcome | | |
|---|---|---|---|---|---|---|---|---|---|---|
| | | | | ATPase | | Permease | | | PCS | |
| | | UreaBP | A | B | A | B | Unrease | $N_{operon}$ | $\bar{\pi}$ | $N_u$ |
| Single components | 1 | 1pea$^b$ | | | | | | 905 | 0.467 | 96 |
| | 2 | av$^c$ | | | | | | 861 | | |
| | 3 | cg$^d$ | | | | | | 1141 | | |
| | 4 | 1pea∩ av∩ cg | | | | | | 837 | 0.426 | 96 |
| | 5 | | av$^e$ | | | | | 2102 | | |
| | 6 | | | av$^f$ | | | | 5701 | | |
| | 8 | | cg$^g$ | | | | | 2745 | | |
| | 9 | | | cg$^h$ | | | | 5541 | | |
| | 10 | | av∩cg | | | | | 1527 | | |
| | 11 | | | av∩cg | | | | 3858 | | |
| | 12 | | | | av$^i$ | | | 77 | | |
| | 13 | | | | | av$^j$ | | 2623 | | |
| | 15 | | | | cg$^k$ | | | 595 | | |
| | 16 | | | | | cg$^l$ | | 500 | | |
| | 17 | | | | av∩cg | | | 15 | | |
| | 18 | | | | | av∩cg | | 388 | | |
| | 19 | | | | | | 1ef2$^m$ | 987 | | |
| ABC transporters | 20 | | av | av | av | av | | 30 | | |
| | 21 | | cg | cg | cg | cg | | 356 | | |
| | 22 | | av∩cg | av∩cg | av∩cg | av∩cg | | 10 | | |
| PBP and transporters | 23 | 1pea∩ av∩ cg | av | av | av | av | | 21 | 0.108 | 4 |
| | 24 | 1pea∩ av∩ cg | cg | cg | cg | Cg | | 200 | 0.256 | 9 |
| | 25 | 1pea∩ av∩ cg | av∩cg | av∩cg | av∩cg | av∩cg | | 6 | 0 | 1 |
| Unrease and transporters | 26 | | Av | av | av | av | 1ef2 | 0 | | |
| | 27 | | cg | cg | cg | cg | 1ef2 | 44 | | |
| | 28 | | av∩cg | av∩cg | av∩cg | av∩cg | 1ef2 | 0 | | |

TABLE 2-continued

Operon linkage relationships[a].

| | | UreaBP | Operon membership | | | | | Outcome | | |
| | | | ATPase | | Permease | | | PCS | | |
| | | | A | B | A | B | Unrease | $N_{operon}$ | $\bar{\pi}$ | $N_u$ |
|---|---|---|---|---|---|---|---|---|---|---|
| All | 29 | 1pea∩ av∩ cg | av | av | av | av | 1ef2 | 0 | | |
| | 30 | 1pea∩ av∩ cg | cg | cg | cg | cg | 1ef2 | 27 | 0.230 | 5 |
| | 31 | 1pea∩ av∩ cg | av∩cg | av∩cg | av∩cg | av∩cg | 1ef2 | 0 | | |
| PBP and unrease | 32 | 1pea∩ av∩ cg | | | | | 1ef2 | 35 | 0.268 | 8 |

[a]Operons are defined as contiguous strings of open reading frames located on the same DNA strand, each with an inter-genic distances of ≤100 bp. Homology families are defined for each of the individual components (lines 1-19) according to the BLAST search criteria defined in the footnotes. Homology families also can be constructed as intersections of multiple searches for a given component (e.g. 1pea∩ av∩ cg, line 4, is the set of hits common to the searches of lines 1-3). $N_{operon}$ gives the number of hits that satisfy the operon combination rules (for single components, lines 1-19, it defines the size of the homology family; for ABC transporters, lines 20-22, it defines the number of operons that contain both ATPases and Permeases, etc.). The two PCS columns provide information on the diversity of the PCS sequences defined for paAmiC (1pea). Nu is the number of unique PCS sequences. $\bar{\pi}$ is the average diversity of the PCS sequences, calculated as follows. At each PCS position, i, the residue entropy is calculated:

$$s_i = -\sum_{aa} f_{aa} \ln f_{aa}$$

where $f_{aa}$ is the frequency of amino acid aa (including indels, for a total of 21 choices) at that position. The maximum entropy is know: it is the entropy at which all amino acids (and indel) occur with equal probability:

$$s_{max} = -\sum_{aa} \frac{1}{21} \ln \frac{1}{21} = \ln 21 \approx 3.044$$

We therefore can define a normalized entropy, or "diversity", at each position:

$$\delta_i = \frac{s_i}{s_{max}}$$

$\delta_i$ varies from 0 (no diversity) to 1 (random). For a PCS sequence comprising n residues, we define an average diversity $$\bar{\pi} = \frac{1}{n}\sum_{i=1}^{n} \delta_i$$

[b]Probe is sequence from PDB accession 1pea; minimum allowed fraction of identical residues, $f_{min} = 0.25$
[c]Probe is taken from *Anabaena variabilis* genomic sequence NC_007413, protein identifier YP_324854.1, $f_{min} = 0.25$.
[d]*Corynebacterium glutamicum*, genome NC_022040, protein YP_008401061.1, $f_{min} = 0.25$.
[e]*A. variabilis* genome NC_007413, protein YP_324857.1, $f_{min} = 0.35$.
[f]*A. variabilis* genome NC_007413, protein YP_324858.1, $f_{min} = 0.35$.
[g]*C. Glutamicum*, genome NC_022040, protein YP_008401064.1, $f_{min} = 0.35$.
[h]*C. Glutamicum*, genome NC_022040, protein YP_008401065.1, $f_{min} = 0.35$.
[i]*A. variabilis* genome NC_007413, protein YP_324855.1, $f_{min} = 0.25$.
[j]*A. variabilis* genome NC_007413, protein YP_324855.1, $f_{min} = 0.25$.
[k]*C. Glutamicum*, genome NC_022040, protein YP_008401062.1, $f_{min} = 0.35$.
[l]*C. Glutamicum*, genome NC_022040, protein YP_008401063.1, $f_{min} = 0.35$.
[m]PDB accession 1ef2, $f_{min} = 0.35$.

Figure 4A:
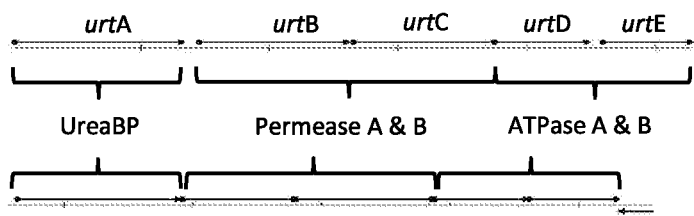
FIGS. 4A-B are a diagrams showing linkage relationships in the *Anabaena variabilis* and *Corynebacterium glutamicum* urea uptake operons. a. *A. variabilis* (genome NC_007413). Genes: urtA, YP_324854.1; urtB, YP_324855.1; urtC, YP_324856.1; urtD, YP_3248557.1; urtE, YP_324858.1. b. *C. glutamicum* (genome NC_022040). Genes: urtA, YP_008401061.1; urtB, YP_008401062.1; urtC, YP_008401063.1; urtD, YP_008401064.1; urtE, YP_008401065.1. Each tick mark of the rulers of FIGS. 4A and 4B shows 1 kb of spacing. Figure generated with 'GenomeViewer'.
Figure 4B:

Next we used genomic contextual information to identify the subset of homologs that are likely to have urea-rather than acetamide-binding properties by exploiting the observation that in prokaryotes related functions frequently are organized into operons (Osbourn, 2009, *Cell. Mol. Life Sci.*, 66, 3755-3775; Overbeek et al., 1999, *Proc Natl Acad Sci USA*, 96, 2896-901). PBPs often are components of multicomponent ABC transporter systems arranged in operons. Both avUBP and gsUBP are located in operons that also contain the permease and ATPase heterodimers of the ABC transporter components for urea uptake (FIG. 4). If any of these polycistronically linked components encode specificity for urea, linkage relationships between their homologs and the AmiC homologs may identify subsets of the latter that are specific for urea. We therefore constructed homology families for the ATPase and permease heterodimers taken from *A. variabilis* (ATPase subunits seeds: NC_007413|YP_324857.1, NC_007413|YP_324858.1; permease subunits seeds: NC_007413|YP_324855.1, NC_007413|YP_324856.1) and *C. glutamicum* (ATPase subunits seeds: NC_022040|YP_008401064.1, NC_022040|YP_008401065.1; permease subunits seeds: NC_022040|YP_008401062.1, NC_022040|YP_008401063.1), using 35% minimum identity threshold (Table 2, lines 5-9).

Functional constraints are expected to manifest themselves as a lessening in the sequence diversity of the PCS and the number of hits in the paAmiC homology family. These effects were clearly observed in the various combinations of the components (Table 3). The combined set comprising the intersection of the paAmiC, avUBP, and cgUBP homology families restrained the PCS diversity (Table 2, line 4). Various operons linkages were constructed using the 'OntologyMgr' and 'LinkageViewer' programs. Linkage of the combined set with all four transporter components (Table 2, lines 23-25) resulted in the emergence of dominant sequences, which are two nearly identical sequences in the most conservatively selected set of components (line 25).

TABLE 3

PCS sequences in selected operon combinations.

| Operon membership | Line[a] | 85 | 104 | 106 | 107 | 150 | 152 | 206 | 233 | f (%)[c] |
|---|---|---|---|---|---|---|---|---|---|---|
| paAmiC | | S | Y | T | P | Y | V | V | T | 100 |
| PBP and transporters | 23 | | | *I* | *Q* | | *Y* | *N* | *E* | 38 |
| | | | | I | Q | | F | N | E | 24 |
| | | | | V | Q | | F | N | S | 14 |
| | | | | | Q | | F | | M | 14 |
| | | | | I | Y | | F | N | E | 5 |
| | | | | V | E | | Y | N | E | 5 |
| | 24 | | | *F* | *Q* | | *V* | *N* | *E* | 31 |
| | | | | V | Q | | F | N | S | 21 |
| | | | | V | Q | | Y | N | E | 16 |
| | | | | | F | | W | | S | 11 |
| | | | | V | Q | | F | N | E | 7 |
| | | | | | F | | W | | E | 6 |
| | | | | I | Q | | F | N | S | 1 |
| | | | | | F | | W | | A | 1 |
| | | | | | L | | Y | | | 1 |
| | | | | | Y | | Y | | E | <1 |
| | | | | Q | Q | | F | | E | <1 |
| | | | | | C | | W | | | <1 |
| | 25 | | | *I* | *Q* | | *Y* | *N* | *E* | 66 |
| | | | | V | Q | | F | N | S | 33 |
| All | 30 | | | *F* | *Q* | | *V* | *N* | *E* | 25 |
| | | | | F | Q | | Y | N | E | 25 |
| | | | | V | Q | | F | N | S | 22 |
| | | | | V | Q | | Y | N | E | 14 |
| | | | | I | Q | | F | N | S | 4 |
| | | | | Q | Q | | F | | E | 4 |
| | | | | | F | | W | | A | 4 |
| | | T | W | | W | | F | | | 4 |
| PBP and urease | 32 | | | *F* | *Q* | | *V* | *N* | *E* | 23 |
| | | | | V | Q | | F | N | E | 20 |
| | | | | V | Q | | F | N | S | 17 |
| | | | | V | Q | | Y | N | E | 14 |
| | | | | Q | Q | | F | | E | 9 |
| | | | | | Y | | Y | | V | 3 |
| | | | | S | F | | F | G | S | 3 |
| | | | | Q | Q | | F | | C | 3 |
| | | | | | F | | W | | A | 3 |
| | | | T | Q | F | | W | L | A | 3 |
| | | | T | W | W | | F | | | 3 |

[a] See Table 2.
[b] Compared against the wild-type paAmiC. Only differences are shown. The dominant sequences are shown in bold italic.
[c] frequency of sequence in the set.

We also examined the linkage relationship between the paAmiC homologs and urease a subunit homologs. The hydrolysis of urea into bicarbonate and ammonia by urease can be regarded as the first committed step in urea catabolism. Metabolite uptake and first committed steps also are often combined into operons. A urease homolog set was constructed using the *Klebsiella aerogenes* urease as a seed, extracted from the PDb entry 1ef2 (Yamaguchi et al., 1999, *J Biol Inorg Chem,* 4, 468-77). A 30% identity minimum threshold was used (Table 2, line 18). Operons that combine the urease a subunit and paAmiC homolog sets yielded the same dominant PCS sequence as was identified in the operons based on ABC transporter membrane components.

These two analyses of the contextual genomic information identified a PCS sequence that is predicted to define urea-binding proteins within the paAmiC homolog set (Table 1). This PCS replaces three hydrophobic residues that surround the acetamide methyl group with residues that could function as multiple hydrogen-bond acceptors consistent with the conversion of the methyl group into an amine.

Figure 5A:
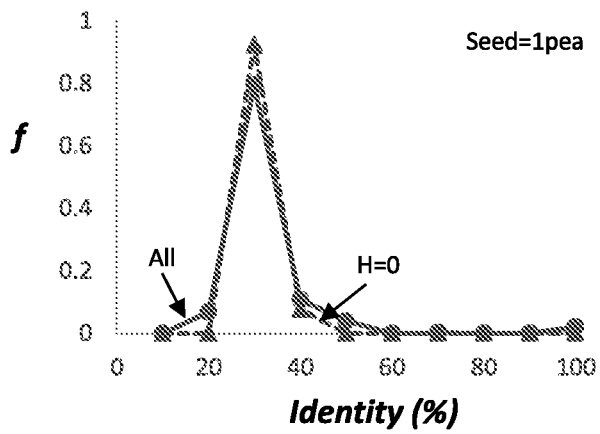
FIGS. 5A-C are graphs showing SAFE homology search statistics.
Figure 5B:
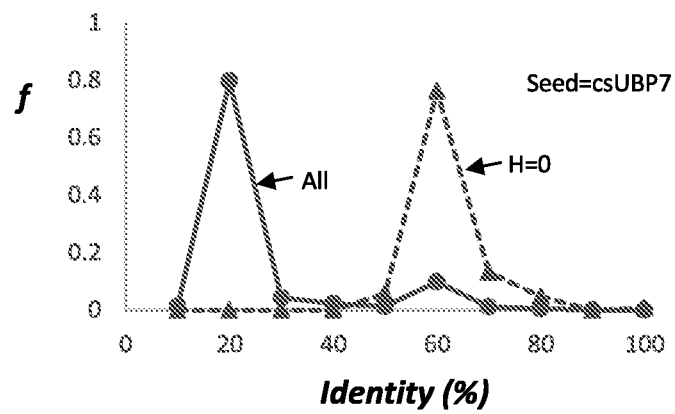

The putative urea-binding PCS was used to identify UBP candidates in the paAmiC homology family. Of the 905 members, 481 were predicted to be UBPs with overall homologies ranging from 51% to 24% sequence identity (FIG. 5A). Several of these hits were identified in thermophilic bacteria, and are correspondingly thermostable ($T_m$ values >60° C.), which is advantageous in the construction of robust biosensors.

Example 3

Sensor Engineering Phase 2: Lead Protein Validation Using Ligand-Mediated Thermostability Shifts Eleven homologs that were predicted to be urea-binding proteins (FIG. 6) were selected to probe different degrees of sequence identity to the paAmiC (PDB accession, 1pea) seed, and to identify UBPs in thermophilic bacteria. The urea-binding properties of these leads were determined experimentally (Table 4). These experiments comprise four successive steps:
1. Synthetic gene construction. The amino acid sequence of the homology leads were backtranslated into DNA sequences. These were optimized for directing heterologous cytoplasmic expression of the protein homologues in *E. coli*, using the OrfOpt program (U.S. Patent Publication No. 2011/0171737, hereby incorporated by reference). This program predicts mRNA sequences that direct high-level protein expression in *E. coli*. The predicted gene sequences were assembled de novo from synthetic oligonucleotides.
2. Heterologous protein expression of the homologues in *E. coli*. Plasmids carrying the synthetic expression constructs (see above) were transformed into KRX (*E. coli* K12 derivative strain) competent cells (Promega, Technical Bulletin TB352). Protein production was induced in bacterial cultures of these cultures.
3. Purification of successfully expressed protein using immobilized metal affinity chromatography.
4. Verification of urea binding. Determination of the urea-binding properties of the purified proteins using a thermal stability shift assay.

Figure 6:
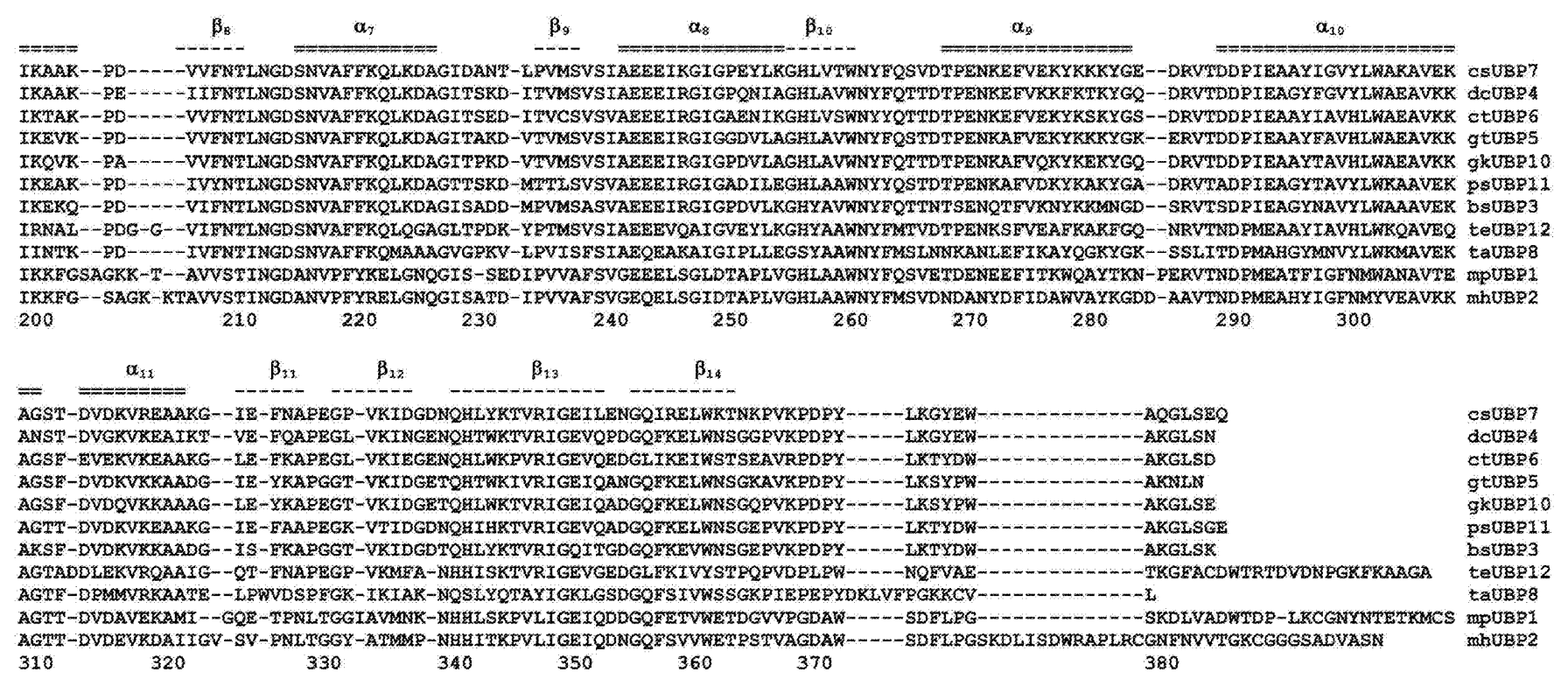

Secretion of PBPs into the periplasm is directed by leader peptide sequences (Eitinger, 2011, *FEMS Microbiol. Rev.*, 35, 3-67). This leader sequence is usually removed in PBP expression constructs, so that the soluble form of the mature protein is produced in the cytoplasm. Alignment of the eleven sequences clearly indicates the start of the mature polypeptide (FIG. 6). Nevertheless, we explored a number of different starting points in the expression constructs. In all constructs we terminated the sequence with a hexahistidine tag to facilitate protein purification. In constructs for gkUBP10, psUBP11, and tsUBP12 we also fused a Flag-acidic-target-tag (FATT) hyperacidic region (FATT domain) to the N-terminus (Sangawa et al. 2013 Protein Sci, 22, 840-50), which has been shown to significantly enhance proper folding of expressed proteins (Wood, 2014, *Curr Opin Struct Biol*, 26, 54-61).

Seven of the eleven leads (including all three FATT fusions), produced soluble protein in a T7 expression system in sufficient quantity for functional analysis. The urea-binding properties of all seven were confirmed directly using the thermal shift assay (Table 4).

Example 4

Sensor Engineering Phase 3: Determination of csUBP7 Structure

Figure 7A:
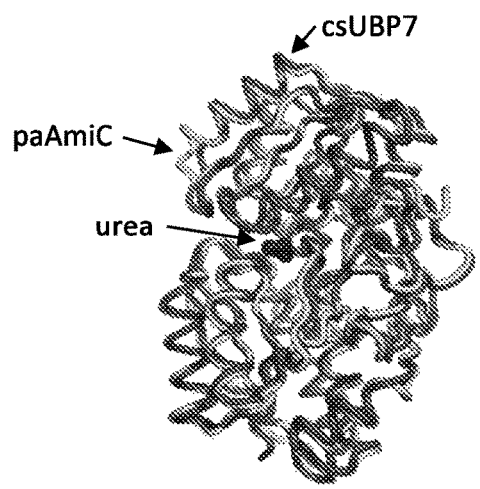
FIGS. 7A-C are structures and structural aspects of csUBP7 determined by X-ray crystallography.
Figure 7B:
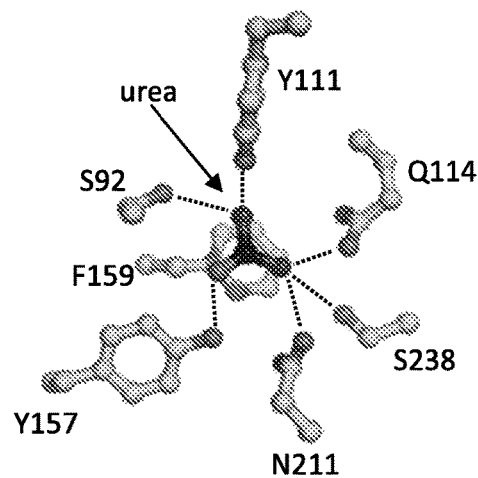
Figure 7C:
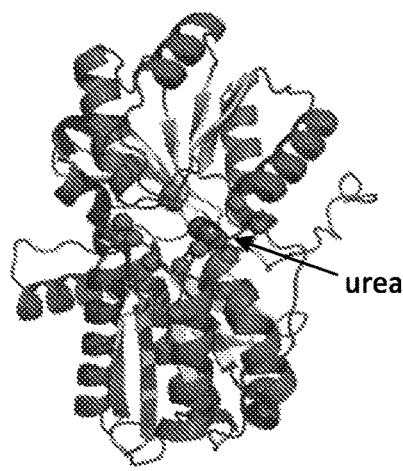
Figure 10A:
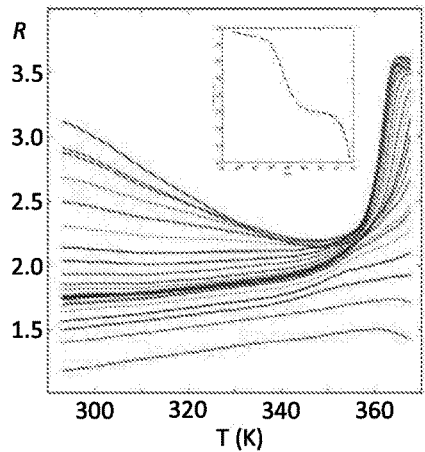
Figure 10D:
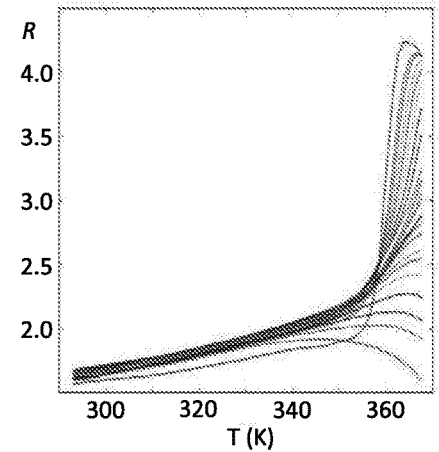
Figure 10B:
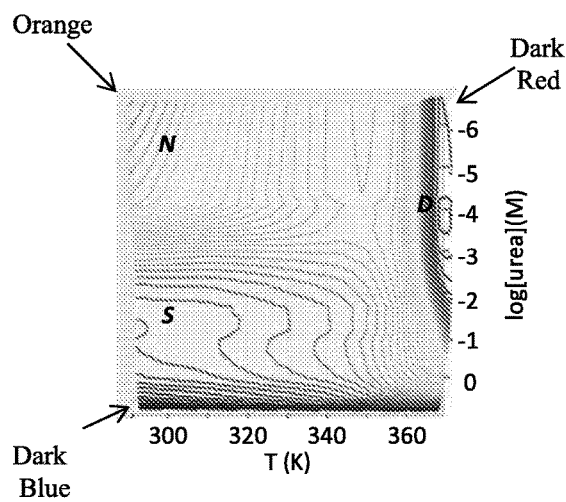
Figure 10E:
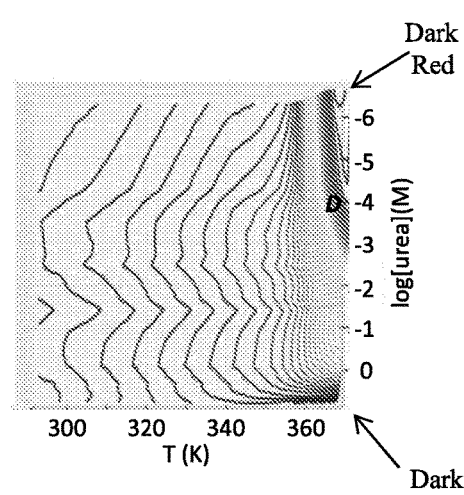

The crystal structure of *Caldicellusiruptor saccharolyticus* urea-binding protein (csUBP7) was determined by high-resolution X-ray crystallography (Table 5). The overall structure is similar to paAmiC, superimposing with a backbone RMSD of 1.0 Å (FIG. 7). The automatically assigned secondary structure elements are largely conserved (FIG. 8), although there are some subtle differences in their boundaries. Furthermore, csUBP7 α helix 8 is replaced by a less regular region in paAmiC; similarly β strand 11 in csUBP7 is not present in paAmiC.

TABLE 5

| X-ray structure determination of csUBP7 | |
| --- | --- |
| X-ray source | SIBYLS 12.3.1, ALS |
| Wavelength (Å) | 1.016 |
| Space Group | $P2_12_12_1$ |
| Unit Cell parameters (Å) | |
| a, b, c | 79.20, 91.60, 96.52 |
| Resolution range (Å) | 50.00-1.79 (1.84-1.79) [a] |
| Completeness (%) | 99.7 (98.7) [a] |
| No. of unique reflections | 65961 |
| Wilson B-factor ($Å^2$) | 12.30 |
| Multiplicity | 10.04 (9.38) [a] |
| R-sym (%) | 0.30 (2.19) [a] |
| R-pim (%) | 0.09 (0.71) [a] |
| Mean I/σ (I) | 8.16 (1.08) [a] |
| Refinement statistics | |
| R factor (%) | 18.67 |
| Free_R_factor (%) | 23.58 |
| Average B-factor ($Å^2$) | 16.50 |
| Macromolecules | 14.00 |
| Urea | 8.80 |
| Water | 30.50 |

TABLE 4

Ligand-binding and thermostability properties of UBP candidates.

| | | NCBI Accession codes | | | Soluble | Thermostability | Binding[d] | |
| --- | --- | --- | --- | --- | --- | --- | --- | --- |
| Name | Organism | Genome | Protein | Identity[a] | expression[b] | $^{apo}T_m$ (° C.)[c] | Urea | Acetamide |
| mpUBP1 | *Marinomonas posidonica* | NC_015559 | YP_004483096.1 | 0.26 | n | | | |
| mhUBP2 | *Marinobacter hydrocarbanoclasticus* | NC_017067 | YP_005430828.1 | 0.27 | y | <25[e] | y | |
| bsUBP3 | *Bacillus* sp. | NC_017743 | YP_006233530.1 | 0.28 | y | 51 | y | n |
| dcUBP4 | *Desulfotomaculum carboxydivorans* | NC_015565 | YP_004496535.1 | 0.28 | n | | | |
| gtUBP5 | *Geobacillus thermoglucosidasius* | NC_015660 | YP_004588319.1 | 0.31 | n | | | |
| ctUBP6 | *Clostridium thermocellum* | NC_009012 | YP_001038237.1 | 0.51 | y | 89 | y | n |
| csUBP7 | *Caldicellulosiruptor saccharolyticus* | NC_009437 | YP_001181243.1 | 0.30 | y | 67 | y | n |
| taUBP8 | *Thermocrinis albus* | NC_013894 | YP_003473480.1 | 0.27 | n | | | |
| gkUBP10 | *Geobacillus kaustophilus* | NC_006510 | YP_147790.1 | 0.30 | y | >100 | nd | |
| psUBP11 | *Paenibacillus* sp. | NC_013406 | YP_003241723.1 | 0.29 | y | 80 | y | |
| teUBP12 | *Thermosynechococcus elongatus* | NC_004113 | NP_681910.1 | 0.30 | y | 84 | y | |

[a]Number of identical residues shared with the paAmiC probe sequence.
[b]Judged by SDS gel electrophoresis of the soluble fraction of a total lysate.
[c]Determined in a Roche LightCycler, using SYPRO Orange to monitor the appearance of unfolded protein.
[d]Determined by monitoring an increase in the thermostability of the protein in the presence of ligand. nd, not determined; too thermostable to determine.
[e]Unfolded at room temperature in the absence of urea.

TABLE 5-continued

X-ray structure determination of csUBP7

No. of nonhydrogen atoms

| | |
|---|---|
| Macromolecule | 5818 |
| Urea | 8 |
| Water | 1037 |
| RMS deviations | |
| RMS (bonds) | 0.006 |
| RMS (angles) | 0.908 |
| Ramachandran favoured (%) | 97.56 |
| Ramachandran Allowed (%) | 2.44 |
| Ramachandran outliers (%) | 0.00 |
| Rotamer outliers (%) | 0.49 |
| Clashscore | 4.97 |

[a] Values for highest resolution shell are given in parentheses.

The structure of the csUBP7 urea complex (FIG. 7B) confirms the accuracy of the urea-binding PCS deduced from the bioinformatics analysis described above. In many planar ligands bound by PBPs, both ligand faces form extensive van der Waals interactions with the protein, often by stacking against the rings of aromatic amino acids. In paAmiC one face of the acetamide stacks against a tyrosine, whereas the opposing forms less extensive van der Waals interactions with a threonine. Both types of interactions are retained in csUBP7, with the aromatic interaction contributed by F159 (Y152 in paAmiC), and the opposing face by V113 (T106 in paAmiC).

The hydrogen-bonding potential of acetamide and urea are fully satisfied in both complexes. The donor hydrogen bonds to the carbonyl by tyrosine, and serine hydroxyl protons are retained. The amine group that is common to both acetamide and urea is bound by a single hydrogen bond acceptor, contributed by a tyrosine hydroxyl oxygen in both proteins. Remarkably, the hydrophobic surface that contacts the methyl group in paAmiC is replaced by three hydrogen bond acceptors, all of which interact with the second amine group in urea. In addition to contributing to the affinity of the interaction, this redundancy of interactions may confer specificity by selecting against groups that cannot form these hydrogen bonds.

The csUBP7 structure was used to aid in the identification of mutations that convert csUBP7 into a fluorescently responsive urea sensors tuned to respond optimally in the clinically relevant urea concentration range (sensor engineering phases 4 and 5). It was also used to execute a SAFE search for UBP homologs, using the csUBP7 sequence as the seed, its PCS as the structure-based filter for function, and a more aggressive minimum identity threshold of 15%. The resulting set contains a total of 4732 sequences, of which 351 are predicted to be urea-binding proteins, based on their PCS Hamming score (H=0). Unlike the UBPs in this subset (Table 6) that are more closely related to the seed (identity varies from 100% to 43%) than is the case for the paAmiC set (compare FIGS. 5A and B).

TABLE 6

Urea-Binding Proteins

| | | PCS position and sequence | | | | | | | |
|---|---|---|---|---|---|---|---|---|---|
| # | Accession | 92 | 111 | 113 | 114 | 157 | 159 | 211 | 238 |
| 1 | csUBP7 (seed structure) | S | Y | V | Q | Y | F | N | S |
| 2 | NC_009437\|YP_001181243.1 | S | Y | V | Q | Y | F | N | S |
| 3 | NC_015565\|YP_004496535.1 | S | Y | V | Q | Y | F | N | S |
| 4 | NC_015660\|YP_004588319.1 | S | Y | V | Q | Y | F | N | S |
| 5 | NC_014650\|YP_003989571.1 | S | Y | V | Q | Y | F | N | S |
| 6 | NC_009012\|Cthe_1823 | S | Y | V | Q | Y | F | N | S |
| 7 | NC_006510\|YP_147790.1 | S | Y | V | Q | Y | F | N | S |
| 8 | NC_014915\|YP_004132472.1 | S | Y | V | Q | Y | F | N | S |
| 9 | NC_019897\|YP_007214722.1 | S | Y | V | Q | Y | F | N | S |
| 10 | NC_015172\|YP_004266518.1 | S | Y | V | Q | Y | F | N | S |
| 11 | NC_017672\|B2K_05545 | S | Y | V | Q | Y | F | N | S |
| 12 | NC_013406\|YP_003241723.1 | S | Y | V | Q | Y | F | N | S |
| 13 | NC_012914\|YP_003009323.1 | S | Y | V | Q | Y | F | N | S |
| 14 | NC_017743\|YP_006233530.1 | S | Y | V | Q | Y | F | N | S |
| 15 | NC_016047\|YP_004879238.1 | S | Y | V | Q | Y | F | N | S |
| 16 | NC_015681\|YP_004625975.1 | S | Y | V | Q | Y | F | N | S |
| 17 | NC_010162\|YP_001616222.1 | S | Y | V | Q | Y | F | N | S |
| 18 | NC_021658\|SCE1572_33595 | S | Y | V | Q | Y | F | N | S |
| 19 | NC_017079\|YP_005440252.1 | S | Y | V | Q | Y | F | N | S |
| 20 | NC_002570\|NP_241117.1 | S | Y | V | Q | Y | F | N | S |
| 21 | NC_022657\|AFR_30995 | S | Y | V | Q | Y | F | N | S |
| 22 | NC_014501\|YP_003886632.1 | S | Y | V | Q | Y | F | N | S |
| 23 | NC_013510\|YP_003300817.1 | S | Y | V | Q | Y | F | N | S |
| 24 | NC_014666\|YP_004018654.1 | S | Y | V | Q | Y | F | N | S |
| 25 | NC_019729\|YP_007118759.1 | S | Y | V | Q | Y | F | N | S |
| 26 | NC_013093\|YP_003099469.1 | S | Y | V | Q | Y | F | N | S |
| 27 | NC_013739\|YP_003395291.1 | S | Y | V | Q | Y | F | N | S |
| 28 | NC_020990\|YP_007744365.1 | S | Y | V | Q | Y | F | N | S |
| 29 | NC_011729\|YP_002378135.1 | S | Y | V | Q | Y | F | N | S |
| 30 | NC_019729\|YP_007114178.1 | S | Y | V | Q | Y | F | N | S |
| 31 | NC_019738\|YP_007121944.1 | S | Y | V | Q | Y | F | N | S |
| 32 | NC_010296\|YP_001655636.1 | S | Y | V | Q | Y | F | N | S |
| 33 | NC_019683\|YP_007069535.1 | S | Y | V | Q | Y | F | N | S |
| 34 | NC_004113\|NP_681910.1 | S | Y | V | Q | Y | F | N | S |
| 35 | NC_019689\|YP_007081161.1 | S | Y | V | Q | Y | F | N | S |
| 36 | NC_003155\|NP_822365.1 | S | Y | V | Q | Y | F | N | S |
| 37 | NC_023033\|NK55_00205 | S | Y | V | Q | Y | F | N | S |

TABLE 6-continued

Urea-Binding Proteins

| | | | | | | | | | |
|---|---|---|---|---|---|---|---|---|---|
| 38 | NC_019753|YP_007142922.1 | S | Y | V | Q | Y | F | N | S |
| 39 | NC_011884|YP_002482982.1 | S | Y | V | Q | Y | F | N | S |
| 40 | NC_019703|YP_007109005.1 | S | Y | V | Q | Y | F | N | S |
| 41 | NC_003272|NP_485991.1 | S | Y | V | Q | Y | F | N | S |
| 42 | NC_020504|YP_007518655.1 | S | Y | V | Q | Y | F | N | S |
| 43 | NC_007413|YP_324854.1 | S | Y | V | Q | Y | F | N | S |
| 44 | NC_019693|YP_007086905.1 | S | Y | V | Q | Y | F | N | S |
| 45 | NC_019693|YP_007086071.1 | S | Y | V | Q | Y | F | N | S |
| 46 | NC_010628|YP_001867917.1 | S | Y | V | Q | Y | F | N | S |
| 47 | NC_019748|YP_007131516.1 | S | Y | V | Q | Y | F | N | S |
| 48 | NC_019776|YP_007163269.1 | S | Y | V | Q | Y | F | N | S |
| 49 | NC_007775|YP_475333.1 | S | Y | V | Q | Y | F | N | S |
| 50 | NC_017039|YP_005386846.1 | S | Y | V | Q | Y | F | N | S |
| 51 | NC_009925|YP_001515222.1 | S | Y | V | Q | Y | F | N | S |
| 52 | NC_021177|SFUL_1229 | S | Y | V | Q | Y | F | N | S |
| 53 | NC_010475|YP_001733664.1 | S | Y | V | Q | Y | F | N | S |
| 54 | NC_017052|YP_005409553.1 | S | Y | V | Q | Y | F | N | S |
| 55 | NC_008312|YP_720098.1 | S | Y | V | Q | Y | F | N | S |
| 56 | NC_019778|YP_007164862.1 | S | Y | V | Q | Y | F | N | S |
| 57 | NC_015434|YP_004406200.1 | S | Y | V | Q | Y | F | N | S |
| 58 | NC_019695|YP_007092842.1 | S | Y | V | Q | Y | F | N | S |
| 59 | NC_008820|YP_001018969.1 | S | Y | I | Q | Y | F | N | S |
| 60 | NC_019745|YP_007126262.1 | S | Y | V | Q | Y | F | N | S |
| 61 | NC_014659|YP_004008499.1 | S | Y | V | Q | Y | F | N | S |
| 62 | NC_019701|YP_007103966.1 | S | Y | V | Q | Y | F | N | S |
| 63 | NC_020506|YP_007530234.1 | S | Y | V | Q | Y | F | N | S |
| 64 | NC_005071|NP_896053.1 | S | Y | I | Q | Y | F | N | S |
| 65 | NC_023150|Y013_09785 | S | Y | V | Q | Y | F | N | S |
| 66 | NC_015564|YP_004491855.1 | S | Y | V | Q | Y | F | N | S |
| 67 | NC_008596|MSMEG_2982 | S | Y | V | Q | Y | F | N | S |
| 68 | NC_004369|NP_737610.1 | S | Y | V | Q | Y | F | N | S |
| 69 | NC_019702|YP_007104586.1 | S | Y | V | Q | Y | F | N | S |
| 70 | NC_018581|KTR9_3419 | S | Y | V | Q | Y | F | N | S |
| 71 | NC_023036|D174_12625 | S | Y | V | Q | Y | F | N | S |
| 72 | NC_016640|YP_005072561.1 | S | Y | V | Q | Y | F | N | S |
| 73 | NC_008146|YP_639455.1 | S | Y | V | Q | Y | F | N | S |
| 74 | NC_008726|YP_953410.1 | S | Y | V | Q | Y | F | N | S |
| 75 | NC_014814|YP_004077591.1 | S | Y | V | Q | Y | F | N | S |
| 76 | NC_016604|YP_005003135.1 | S | Y | V | Q | Y | F | N | S |
| 77 | NC_022115|O5Y_07415 | S | Y | V | Q | Y | F | N | S |
| 78 | NC_021351|YP_008065815.1 | S | Y | V | Q | Y | F | N | S |
| 79 | NC_003450|NCgl0893 | S | Y | V | Q | Y | F | N | S |
| 80 | NC_014151|YP_003635811.1 | S | Y | V | Q | Y | F | N | S |
| 81 | NC_018027|YP_006452781.1 | S | Y | V | Q | Y | F | N | S |
| 82 | NC_016887|YP_005266451.1 | S | Y | V | Q | Y | F | N | S |
| 83 | NC_009482|YP_001228710.1 | S | Y | I | Q | Y | F | N | S |
| 84 | NC_012522|YP_002779037.1 | S | Y | V | Q | Y | F | N | S |
| 85 | NC_008268|YP_702091.1 | S | Y | V | Q | Y | F | N | S |
| 86 | NC_006361|YP_121470.1 | S | Y | V | Q | Y | F | N | S |
| 87 | NC_019675|YP_007046986.1 | S | Y | I | Q | Y | Y | N | S |
| 88 | NC_019682|YP_007067425.1 | S | Y | V | Q | Y | F | N | S |
| 89 | NC_011593|Blon_0104 | S | Y | L | Q | Y | F | N | S |
| 90 | NC_007516|YP_382900.1 | S | Y | I | Q | Y | Y | N | S |
| 91 | NC_008819|YP_001015739.1 | S | Y | I | Q | Y | F | N | S |
| 92 | NC_009439|YP_001186201.1 | S | Y | V | Q | Y | Y | N | S |
| 93 | NC_007513|YP_378251.1 | S | Y | I | Q | Y | F | N | S |
| 94 | NC_019757|YP_007145356.1 | S | Y | V | Q | Y | F | N | S |
| 95 | NC_019771|YP_007156061.1 | S | Y | V | Q | Y | F | N | S |
| 96 | NC_005966|YP_046426.1 | S | Y | V | Q | Y | Y | N | S |
| 97 | NC_018708|YP_006853378.1 | S | Y | V | Q | Y | Y | N | S |
| 98 | NC_010524|YP_001790118.1 | S | Y | V | Q | Y | Y | N | S |
| 99 | NZ_AHJG00000000|WP_010193380.1 | S | Y | I | Q | Y | F | N | S |
| 100 | NC_013421|YP_003259868.1 | S | Y | V | Q | Y | Y | N | S |
| 101 | NC_018525|YP_006646896.1 | S | Y | V | Q | Y | Y | N | S |
| 102 | NC_017845|YP_006283434.1 | S | Y | V | Q | Y | Y | N | S |
| 103 | NC_007577|YP_397325.1 | S | Y | I | Q | Y | F | N | S |
| 104 | NC_015556|YP_004476124.1 | S | Y | V | Q | Y | Y | N | S |
| 105 | NC_009792|YP_001453130.1 | S | Y | V | Q | Y | Y | N | S |
| 106 | NC_013194|YP_003166447.1 | S | Y | V | Q | Y | Y | N | S |
| 107 | NC_012917|YP_003017736.1 | S | Y | V | Q | Y | Y | N | S |
| 108 | NC_018405|YP_006578678.1 | S | Y | V | Q | Y | Y | N | S |
| 109 | NC_008786|YP_997959.1 | S | Y | V | Q | Y | Y | N | S |
| 110 | NC_012912|YP_003005049.1 | S | Y | V | Q | Y | Y | N | S |
| 111 | NC_023032|P262_02860 | S | Y | V | Q | Y | Y | N | S |
| 112 | NC_023065|YP_008937889.1 | S | Y | V | Q | Y | F | N | S |
| 113 | NC_008702|YP_931642.1 | S | Y | V | Q | Y | F | N | S |
| 114 | NC_004547|YP_050239.1 | S | Y | V | Q | Y | Y | N | S |
| 115 | NC_016845|YP_005226838.1 | S | Y | V | Q | Y | Y | N | S |

TABLE 6-continued

| | | Urea-Binding Proteins | | | | | | | |
|---|---|---|---|---|---|---|---|---|---|
| 116 | NC_015061\|YP_004210833.1 | S | Y | V | Q | Y | Y | N | S |
| 117 | NC_001264\|NP_285643.1 | S | Y | V | Q | Y | Y | N | S |
| 118 | NC_007973\|YP_583107.1 | S | Y | V | Q | Y | Y | N | S |
| 119 | NC_008463\|YP_793325.1 | S | Y | V | Q | Y | Y | N | S |
| 120 | NC_007969\|YP_580259.1 | S | Y | V | Q | Y | Y | N | S |
| 121 | NC_017532\|YP_005940407.1 | S | Y | V | Q | Y | Y | N | S |
| 122 | NC_007298\|YP_284662.1 | S | Y | V | Q | Y | Y | N | S |
| 123 | NC_009850\|YP_001489733.1 | S | Y | V | Q | Y | Y | N | S |
| 124 | NC_021046\|YP_007845048.1 | S | Y | V | Q | Y | Y | N | S |
| 125 | NC_023075\|X969_23120 | S | Y | V | Q | Y | Y | N | S |
| 126 | NC_013716\|YP_003365082.1 | S | Y | V | Q | Y | Y | N | S |
| 127 | NC_007908\|Rfer_3381 | S | Y | V | Q | Y | Y | N | S |
| 128 | NC_015677\|YP_004620409.1 | S | Y | V | Q | Y | Y | N | S |
| 129 | NC_013894\|YP_003473480.1 | S | Y | V | Q | Y | F | N | S |
| 130 | NC_015726\|YP_004684855.1 | S | Y | V | Q | Y | Y | N | S |
| 131 | NC_014837\|YP_004114477.1 | S | Y | V | Q | Y | Y | N | S |
| 132 | NC_014562\|YP_003929719.1 | S | Y | V | Q | Y | Y | N | S |
| 133 | NC_015138\|YP_004235852.1 | S | Y | V | Q | Y | Y | N | S |
| 134 | NC_008781\|YP_981235.1 | S | Y | V | Q | Y | Y | N | S |
| 135 | NC_021066\|YP_007873403.1 | S | Y | V | Q | Y | Y | N | S |
| 136 | NC_015968\|YP_004828644.1 | S | Y | V | Q | Y | Y | N | S |
| 137 | NC_013850\|YP_003439644.1 | S | Y | V | Q | Y | Y | N | S |
| 138 | NC_007948\|YP_548240.1 | S | Y | V | Q | Y | Y | N | S |
| 139 | NC_010322\|YP_001671118.1 | S | Y | V | Q | Y | Y | N | S |
| 140 | NC_015224\|YP_004297604.1 | S | Y | V | Q | Y | Y | N | S |
| 141 | NC_021591\|YP_008137498.1 | S | Y | V | Q | Y | Y | N | S |
| 142 | NC_009778\|YP_001437860.1 | S | Y | V | Q | Y | Y | N | S |
| 143 | NC_016816\|YP_005197101.1 | S | Y | V | Q | Y | Y | N | S |
| 144 | NC_017075\|YP_005438782.1 | S | Y | V | Q | Y | Y | N | S |
| 145 | NC_016818\|YP_005198188.1 | S | Y | V | Q | Y | Y | N | S |
| 146 | NC_018106\|YP_006498850.1 | S | Y | V | Q | Y | Y | N | S |
| 147 | NC_008255\|YP_677867.1 | S | Y | V | Q | Y | F | N | S |
| 148 | NC_009656\|YP_001350899.1 | S | Y | V | Q | Y | Y | N | S |
| 149 | NC_019701\|YP_007102831.1 | S | Y | V | Q | Y | F | N | S |
| 150 | NC_009434\|PST_3720 | S | Y | V | Q | Y | Y | N | S |
| 151 | NC_014306\|YP_003740028.1 | S | Y | V | Q | Y | Y | N | S |
| 152 | NC_023076\|X970_22755 | S | Y | V | Q | Y | Y | N | S |
| 153 | NC_021741\|M495_06585 | S | Y | V | Q | Y | Y | N | S |
| 154 | NC_009436\|YP_001176715.1 | S | Y | V | Q | Y | Y | N | S |
| 155 | NC_020829\|YP_007659756.1 | S | Y | V | Q | Y | Y | N | S |
| 156 | NC_021232\|YP_007991487.1 | S | Y | V | Q | Y | Y | N | S |
| 157 | NC_009256\|YP_001118688.1 | S | Y | V | Q | Y | Y | N | S |
| 158 | NC_020063\|YP_007340042.1 | S | Y | V | Q | Y | Y | N | S |
| 159 | NC_021237\|YP_007997951.1 | S | Y | V | Q | Y | Y | N | S |
| 160 | NC_010528\|YP_002005092.1 | S | Y | V | Q | Y | Y | N | S |
| 161 | NC_012660\|YP_002870258.1 | S | Y | V | Q | Y | Y | N | S |
| 162 | NC_021661\|PSYCG_05205 | S | Y | V | Q | Y | Y | N | S |
| 163 | NC_010551\|YP_001807510.1 | S | Y | V | Q | Y | Y | N | S |
| 164 | NC_013282\|YP_003210547.1 | S | Y | V | Q | Y | Y | N | S |
| 165 | NC_021499\|YP_008105445.1 | S | Y | V | Q | Y | Y | N | S |
| 166 | NC_010682\|YP_001899759.1 | S | Y | V | Q | Y | Y | N | S |
| 167 | NC_021878\|YP_008330726.1 | S | Y | V | Q | Y | Y | N | S |
| 168 | NC_010501\|YP_001751482.1 | S | Y | V | Q | Y | Y | N | S |
| 169 | NC_015566\|YP_004499842.1 | S | Y | V | Q | Y | Y | N | S |
| 170 | NC_010159\|YP_001605869.1 | S | Y | V | Q | Y | Y | N | S |
| 171 | NC_010465\|YP_001721602.1 | S | Y | V | Q | Y | Y | N | S |
| 172 | NC_015567\|YP_004504794.1 | S | Y | V | Q | Y | Y | N | S |
| 173 | NC_018691\|YP_006819365.1 | S | Y | V | Q | Y | Y | N | S |
| 174 | NC_017559\|YP_005996330.1 | S | Y | V | Q | Y | Y | N | S |
| 175 | NC_009832\|YP_001477653.1 | S | Y | V | Q | Y | Y | N | S |
| 176 | NC_015410\|YP_004378570.1 | S | Y | V | Q | Y | Y | N | S |
| 177 | NC_007347\|YP_295209.1 | S | Y | V | Q | Y | Y | N | S |
| 178 | NC_016612\|YP_005020228.1 | S | Y | V | Q | Y | Y | N | S |
| 179 | NC_008027\|YP_610321.1 | S | Y | V | Q | Y | Y | N | S |
| 180 | NC_020211\|YP_007405216.1 | S | Y | V | Q | Y | Y | N | S |
| 181 | NC_020516\|YP_007553848.1 | S | Y | V | Q | Y | Y | N | S |
| 182 | NC_008752\|YP_971829.1 | S | Y | V | Q | Y | Y | N | S |
| 183 | NC_023019\|U769_26650 | S | Y | V | Q | Y | Y | N | S |
| 184 | NC_007005\|YP_237494.1 | S | Y | V | Q | Y | Y | N | S |
| 185 | NC_019936\|YP_007238804.1 | S | Y | V | Q | Y | Y | N | S |
| 186 | NC_011666\|YP_002362311.1 | S | Y | V | Q | Y | F | N | S |
| 187 | NC_015379\|YP_004351756.1 | S | Y | V | Q | Y | Y | N | S |
| 188 | NC_017920\|YP_006331902.1 | S | Y | V | Q | Y | Y | N | S |
| 189 | NC_017192\|YP_005553223.1 | S | Y | V | Q | Y | Y | N | S |
| 190 | NC_009648\|YP_001335277.1 | S | Y | V | Q | Y | Y | N | S |
| 191 | NC_010084\|YP_001580663.1 | S | Y | V | Q | Y | Y | N | S |
| 192 | NC_018513\|YP_006616708.1 | S | Y | V | Q | Y | Y | N | S |
| 193 | NC_014931\|YP_004156925.1 | S | Y | V | Q | Y | Y | N | S |

TABLE 6-continued

Urea-Binding Proteins

| | | | | | | | | | |
|---|---|---|---|---|---|---|---|---|---|
| 194 | NC_007510\|YP_368255.1 | S | Y | V | Q | Y | Y | N | S |
| 195 | NC_010170\|YP_001628898.1 | S | Y | V | Q | Y | Y | N | S |
| 196 | NC_010694\|YP_001906630.1 | S | Y | V | Q | Y | Y | N | S |
| 197 | NC_023064\|U771_03375 | S | Y | V | Q | Y | Y | N | S |
| 198 | NC_010508\|YP_001764180.1 | S | Y | V | Q | Y | Y | N | S |
| 199 | NC_010622\|YP_001858472.1 | S | Y | V | Q | Y | Y | N | S |
| 200 | NC_014307\|YP_003745265.1 | S | Y | V | Q | Y | Y | N | S |
| 201 | NC_004129\|YP_257783.1 | S | Y | V | Q | Y | Y | N | S |
| 202 | NC_020064\|YP_007343826.1 | S | Y | V | Q | Y | Y | N | S |
| 203 | NC_020209\|YP_007400304.1 | S | Y | V | Q | Y | Y | N | S |
| 204 | NC_007492\|YP_346323.1 | S | Y | V | Q | Y | Y | N | S |
| 205 | NC_021577\|M062_25640 | S | Y | V | Q | Y | Y | N | S |
| 206 | NC_008390\|YP_772680.1 | S | Y | V | Q | Y | Y | N | S |
| 207 | NC_004578\|NP_794619.1 | S | Y | V | Q | Y | Y | N | S |
| 208 | NC_012856\|YP_002981823.1 | S | Y | V | Q | Y | Y | N | S |
| 209 | NC_018028\|YP_006456254.1 | S | Y | V | Q | Y | Y | N | S |
| 210 | NC_014640\|YP_003981249.1 | S | Y | V | Q | Y | Y | N | S |
| 211 | NC_016825\|YP_005202834.1 | S | Y | V | Q | Y | Y | N | S |
| 212 | NC_011662\|YP_002890891.1 | S | Y | V | Q | Y | Y | N | S |
| 213 | NC_012997\|YP_003075463.1 | S | Y | V | Q | Y | Y | N | S |
| 214 | NC_012691\|YP_002892824.1 | S | Y | V | Q | Y | Y | N | S |
| 215 | NC_015583\|YP_004538852.1 | S | Y | V | Q | Y | Y | N | S |
| 216 | NC_008825\|YP_001019894.1 | S | Y | V | Q | Y | Y | N | S |
| 217 | NC_021287\|YP_008038261.1 | S | Y | V | Q | Y | Y | N | S |
| 218 | NC_018527\|YP_006653903.1 | S | Y | V | Q | Y | Y | N | S |
| 219 | NC_017574\|YP_006029230.1 | S | Y | V | Q | Y | Y | N | S |
| 220 | NC_011894\|YP_002499775.1 | S | Y | V | Q | Y | Y | N | S |
| 221 | NC_015856\|YP_004753495.1 | S | Y | V | Q | Y | Y | N | S |
| 222 | NC_009720\|YP_001419028.1 | S | Y | V | Q | Y | Y | N | S |
| 223 | NC_023045\|I533_13880 | S | Y | V | Q | Y | Y | N | S |
| 224 | NC_018012\|YP_006414170.1 | S | Y | V | Q | Y | Y | N | S |
| 225 | NC_022904\|U875_22200 | S | Y | V | Q | Y | Y | N | S |
| 226 | NC_008260\|YP_694229.1 | S | Y | V | Q | Y | Y | N | S |
| 227 | NC_008702\|YP_932178.1 | S | Y | V | Q | Y | Y | N | S |
| 228 | NC_017080\|YP_005445276.1 | S | Y | V | Q | Y | F | N | S |
| 229 | NC_009080\|YP_001081579.1 | S | Y | V | Q | Y | Y | N | S |
| 230 | NC_014166\|YP_003655224.1 | S | Y | V | Q | Y | Y | N | S |
| 231 | NC_016589\|YP_004977834.1 | S | Y | V | Q | Y | Y | N | S |
| 232 | NC_021285\|YP_008030417.1 | S | Y | V | Q | Y | Y | N | S |
| 233 | NC_007434\|YP_334499.1 | S | Y | V | Q | Y | Y | N | S |
| 234 | NC_023018\|X636_11960 | S | Y | V | Q | Y | Y | N | S |
| 235 | NC_009654\|YP_001339814.1 | S | Y | V | Q | Y | Y | N | S |
| 236 | NC_012724\|YP_002910660.1 | S | Y | V | Q | Y | Y | N | S |
| 237 | NC_017059\|YP_005417729.1 | S | Y | V | Q | Y | F | N | S |
| 238 | NC_008709\|YP_944287.1 | S | Y | V | Q | Y | Y | N | S |
| 239 | NC_011369\|YP_002282556.1 | S | Y | V | Q | Y | Y | N | S |
| 240 | NC_015381\|YP_004359471.1 | S | Y | V | Q | Y | Y | N | S |
| 241 | NC_021173\|YP_007917465.1 | S | Y | V | Q | Y | Y | N | S |
| 242 | NC_010505\|YP_001754121.1 | S | Y | V | Q | Y | Y | N | S |
| 243 | NC_014034\|YP_003577390.1 | S | Y | V | Q | Y | Y | N | S |
| 244 | NC_007645\|YP_435644.1 | S | Y | V | Q | Y | Y | N | S |
| 245 | NC_011138\|MADE_1014320 | S | Y | V | Q | Y | Y | N | S |
| 246 | NC_015554\|YP_004469428.1 | S | Y | V | Q | Y | Y | N | S |
| 247 | NC_016642\|YP_005081493.1 | S | Y | V | Q | Y | Y | N | S |
| 248 | NC_009659\|YP_001353496.1 | S | Y | V | Q | Y | Y | N | S |
| 249 | NC_008340\|YP_741033.1 | S | Y | V | Q | Y | F | N | S |
| 250 | NC_008836\|YP_001028523.1 | S | Y | V | Q | Y | Y | N | S |
| 251 | NC_007912\|YP_525702.1 | S | Y | V | Q | Y | Y | N | S |
| 252 | NC_010995\|YP_001981733.1 | S | Y | V | Q | Y | Y | N | S |
| 253 | NC_020514\|YP_007546992.1 | S | Y | V | Q | Y | Y | N | S |
| 254 | NC_023137\|Gal_03429 | S | Y | V | Q | Y | Y | N | S |
| 255 | NC_020062\|YP_007337601.1 | S | Y | V | Q | Y | Y | N | S |
| 256 | NC_017082\|YP_005448343.1 | S | Y | V | Q | Y | Y | N | S |
| 257 | NC_007925\|YP_533556.1 | S | Y | V | Q | Y | Y | N | S |
| 258 | NC_010511\|YP_001769493.1 | S | Y | V | Q | Y | Y | N | S |
| 259 | NC_014323\|YP_003778087.1 | S | Y | V | Q | Y | Y | N | S |
| 260 | NC_016585\|YP_004973582.1 | S | Y | V | Q | Y | Y | N | S |
| 261 | NC_014532\|YP_003897340.1 | S | Y | V | Q | Y | Y | N | S |
| 262 | NC_012982\|Hbal_2718 | S | Y | V | Q | Y | F | N | S |
| 263 | NC_013855\|YP_003450097.1 | S | Y | V | Q | Y | Y | N | S |
| 264 | NC_008380\|YP_769320.1 | S | Y | V | Q | Y | Y | N | S |
| 265 | NC_009831\|YP_001475613.1 | S | Y | L | Q | Y | F | N | S |
| 266 | NC_015559\|YP_004483096.1 | S | Y | V | Q | Y | Y | N | S |
| 267 | NC_017964\|YP_006379678.1 | S | Y | V | Q | Y | Y | N | S |
| 268 | NC_014117\|YP_003604284.1 | S | Y | V | Q | Y | Y | N | S |
| 269 | NC_003078\|NP_438057.1 | S | Y | V | Q | Y | Y | N | S |
| 270 | NC_015596\|YP_004556797.1 | S | Y | V | Q | Y | Y | N | S |
| 271 | NC_007951\|YP_557358.1 | S | Y | V | Q | Y | Y | N | S |

TABLE 6-continued

Urea-Binding Proteins

| | | | | | | | | | |
|---|---|---|---|---|---|---|---|---|---|
| 272 | NC_015675\|YP_004612695.1 | S | Y | V | Q | Y | Y | N | S |
| 273 | NC_012586\|YP_002824376.1 | S | Y | V | Q | Y | Y | N | S |
| 274 | NC_009620\|YP_001312922.1 | S | Y | V | Q | Y | Y | N | S |
| 275 | NC_023065\|YP_008937892.1 | S | Y | V | Q | Y | Y | N | S |
| 276 | NC_017059\|YP_005417155.1 | S | Y | V | Q | Y | Y | N | S |
| 277 | NC_015276\|YP_004311256.1 | S | Y | V | Q | Y | Y | N | S |
| 278 | NC_022535\|YP_008633407.1 | S | Y | V | Q | Y | Y | N | S |
| 279 | NC_020888\|YP_007684197.1 | S | Y | V | Q | Y | Y | N | S |
| 280 | NC_004463\|NP_768088.1 | S | Y | V | Q | Y | Y | N | S |
| 281 | NC_008687\|YP_917779.1 | S | Y | V | Q | Y | Y | N | S |
| 282 | NC_016613\|YP_005022836.1 | S | Y | V | Q | Y | Y | N | S |
| 283 | NC_003062\|NP_355366.2 | S | Y | V | Q | Y | Y | N | S |
| 284 | NC_015259\|YP_004302144.1 | S | Y | V | Q | Y | Y | N | S |
| 285 | NC_018000\|YP_006396988.1 | S | Y | V | Q | Y | Y | N | S |
| 286 | NC_016617\|YP_005032267.1 | S | Y | V | Q | Y | Y | N | S |
| 287 | NC_010681\|YP_001894597.1 | S | Y | V | Q | Y | Y | N | S |
| 288 | NC_011985\|YP_002545350.1 | S | Y | V | Q | Y | Y | N | S |
| 289 | NC_014923\|YP_004143235.1 | S | Y | V | Q | Y | Y | N | S |
| 290 | NC_018268\|YP_006559381.1 | S | Y | V | Q | Y | Y | N | S |
| 291 | NC_015572\|YP_004513420.1 | S | Y | V | Q | Y | Y | N | S |
| 292 | NC_015136\|YP_004227222.1 | S | Y | V | Q | Y | Y | N | S |
| 293 | NC_017249\|YP_005613229.1 | S | Y | V | Q | Y | Y | N | S |
| 294 | NC_018695\|YP_006833023.1 | S | Y | V | Q | Y | Y | N | S |
| 295 | NC_016815\|YP_005191649.1 | S | Y | V | Q | Y | Y | N | S |
| 296 | NC_007761\|YP_470808.1 | S | Y | V | Q | Y | Y | N | S |
| 297 | NC_015183\|YP_004279628.1 | S | Y | V | Q | Y | Y | N | S |
| 298 | NC_012850\|YP_002977104.1 | S | Y | V | Q | Y | Y | N | S |
| 299 | NC_009937\|YP_001524674.1 | S | Y | V | Q | Y | Y | N | S |
| 300 | NC_002678\|NP_102500.1 | S | Y | V | Q | Y | Y | N | S |
| 301 | NC_008740\|YP_960262.1 | S | Y | V | Q | Y | Y | N | S |
| 302 | NC_017067\|YP_005430828.1 | S | Y | V | Q | Y | Y | N | S |
| 303 | NC_019973\|YP_007305659.1 | S | Y | V | Q | Y | Y | N | S |
| 304 | NC_017326\|YP_005722442.1 | S | Y | V | Q | Y | Y | N | S |
| 305 | NC_018286\|YP_006564404.1 | S | Y | V | Q | Y | Y | N | S |
| 306 | NC_020453\|YP_007516150.1 | S | Y | V | Q | Y | Y | N | S |
| 307 | NC_009379\|YP_001155981.1 | S | Y | V | Q | Y | Y | N | S |
| 308 | NC_014834\|YP_004108031.1 | S | Y | V | Q | Y | Y | N | S |
| 309 | NC_013422\|YP_003262986.1 | S | Y | V | Q | Y | Y | N | S |
| 310 | NC_009485\|YP_001242809.1 | S | Y | V | Q | Y | Y | N | S |
| 311 | NC_009428\|YP_001167199.1 | S | Y | V | Q | Y | Y | N | S |
| 312 | NC_011989\|YP_002550517.1 | S | Y | V | Q | Y | Y | N | S |
| 313 | NC_008576\|YP_864943.1 | S | Y | V | Q | Y | Y | N | S |
| 314 | NC_021991\|YP_008391987.1 | S | Y | V | Q | Y | Y | N | S |
| 315 | NC_017956\|YP_006371145.1 | S | Y | V | Q | Y | Y | N | S |
| 316 | NC_018697\|YP_006836550.1 | S | Y | V | Q | Y | Y | N | S |
| 317 | NC_011565\|YP_002308907.1 | S | Y | V | Q | Y | F | N | S |
| 318 | NC_003911\|SPO1710 | S | Y | V | Q | Y | Y | N | S |
| 319 | NC_007963\|YP_574362.1 | S | Y | V | Q | Y | Y | N | S |
| 320 | NC_021917\|YP_008372709.1 | S | Y | V | Q | Y | Y | N | S |
| 321 | NC_021905\|REMIM1_CH03377 | S | Y | V | Q | Y | Y | N | S |
| 322 | NC_008435\|YP_782650.1 | S | Y | V | Q | Y | Y | N | S |
| 323 | NC_013446\|CtCNB1_4515 | S | Y | V | Q | Y | Y | N | S |
| 324 | NC_022543\|YP_008641473.1 | S | Y | V | Q | Y | Y | N | S |
| 325 | NC_007493\|RSP_0301 | S | Y | V | Q | Y | Y | N | S |
| 326 | NC_014217\|YP_003693312.1 | S | Y | V | Q | Y | Y | N | S |
| 327 | NC_017111\|YP_005484746.1 | S | Y | V | Q | Y | Y | N | S |
| 328 | NC_007958\|YP_570634.1 | S | Y | V | Q | Y | Y | N | S |
| 329 | NC_010506\|YP_001762134.1 | S | Y | L | Q | Y | F | N | S |
| 330 | NC_010571\|YP_001821102.1 | S | Y | V | Q | Y | Y | N | S |
| 331 | NC_008209\|RD1_2166 | S | Y | V | Q | Y | Y | N | S |
| 332 | NC_015730\|YP_004690268.1 | S | Y | V | Q | Y | Y | N | S |
| 333 | NC_015174\|YP_004270640.1 | S | Y | L | Q | Y | F | N | S |
| 334 | NC_009952\|YP_001534029.1 | S | Y | V | Q | Y | Y | N | S |
| 335 | NC_017506\|YP_005886573.1 | S | Y | V | Q | Y | Y | N | S |
| 336 | NC_014394\|YP_003847887.1 | S | Y | V | Q | Y | F | N | S |
| 337 | NZ_AJVJ00000000\|WP_014963736.1 | S | Y | V | Q | Y | F | N | S |
| 338 | NC_017384\|YP_005795720.1 | S | Y | V | Q | Y | Y | N | S |
| 339 | NC_018655\|YP_006774297.1 | S | Y | V | Q | Y | F | N | S |
| 340 | NC_021291\|YP_008046494.1 | S | Y | V | Q | Y | Y | N | S |
| 341 | NC_022357\|YP_008545103.1 | S | Y | V | Q | Y | F | N | S |
| 342 | NZ_AJVI00000000\|WP_014963736.1 | S | Y | V | Q | Y | F | N | S |
| 343 | NC_016078\|YP_004901286.1 | S | Y | V | Q | Y | Y | N | S |
| 344 | NC_020911\|YP_007703090.1 | S | Y | V | Q | Y | Y | N | S |
| 345 | NC_020908\|YP_007700904.1 | S | Y | V | Q | Y | Y | N | S |

TABLE 6-continued

Urea-Binding Proteins

| | | | | | | | | | |
|---|---|---|---|---|---|---|---|---|---|
| 346 | NC_014008\|YP_003549337.1 | S | Y | V | Q | Y | Y | N | S |
| 347 | NC_016112\|YP_004916295.1 | S | Y | V | Q | Y | F | N | S |
| 348 | NC_013440\|YP_003269659.1 | S | Y | L | Q | Y | Y | N | S |
| 349 | NC_009481\|YP_001224322.1 | S | Y | V | Q | Y | Y | N | S |

| # | Identity | Organism | Temperature | Gram stain |
|---|---|---|---|---|
| 1 | | | | |
| 2 | 0.99 | Caldicellulosiruptor saccharol | Thermophilic | + |
| 3 | 0.79 | Desulfotomaculum carboxydivora | Mesophilic | + |
| 4 | 0.78 | Geobacillus thermoglucosidasiu | Hyperthermophilic | + |
| 5 | 0.78 | Geobacillus sp. | Thermophilic | + |
| 6 | 0.78 | Ruminiclostridium thermocellum | Mesophilic | + |
| 7 | 0.77 | Geobacillus kaustophilus | Thermophilic | + |
| 8 | 0.77 | Geobacillus sp. | Thermophilic | + |
| 9 | 0.77 | Thermobacillus composti | Mesophilic | + |
| 10 | 0.76 | Syntrophobotulus glycolicus | Mesophilic | − |
| 11 | 0.74 | Paenibacillus mucilaginosus | Mesophilic | + |
| 12 | 0.74 | Paenibacillus sp. | Mesophilic | + |
| 13 | 0.74 | Paenibacillus sp. | Mesophilic | + |
| 14 | 0.73 | Bacillus sp. | Mesophilic | + |
| 15 | 0.72 | Bacillus subtilis | Mesophilic | + |
| 16 | 0.71 | Thermodesulfatator indicus | Thermophilic | − |
| 17 | 0.71 | Sorangium cellulosum | Mesophilic | − |
| 18 | 0.7 | Sorangium cellulosum | Mesophilic | − |
| 19 | 0.7 | Caldilinea aerophila | Mesophilic | + |
| 20 | 0.69 | Bacillus halodurans | Mesophilic | + |
| 21 | 0.67 | Actinoplanes friuliensis | Mesophilic | + |
| 22 | 0.66 | Cyanothece sp. | Mesophilic | − |
| 23 | 0.65 | Thermomonospora curvata | Thermophilic | + |
| 24 | 0.65 | Frankia sp. | Mesophilic | + |
| 25 | 0.65 | Oscillatoria nigro-viridis | Mesophilic | + |
| 26 | 0.65 | Actinosynnema mirum | Mesophilic | + |
| 27 | 0.65 | Conexibacter woesei | Mesophilic | + |
| 28 | 0.64 | Streptomyces albus | Mesophilic | + |
| 29 | 0.64 | Cyanothece sp. | Mesophilic | − |
| 30 | 0.64 | Oscillatoria nigro-viridis | Mesophilic | + |
| 31 | 0.64 | Microcoleus sp. | Mesophilic | + |
| 32 | 0.64 | Microcystis aeruginosa | Mesophilic | − |
| 33 | 0.64 | Leptolyngbya sp. | Mesophilic | + |
| 34 | 0.64 | Thermosynechococcus elongatus | Thermophilic | + |
| 35 | 0.64 | Pleurocapsa sp. | Mesophilic | + |
| 36 | 0.63 | Streptomyces avermitilis | Mesophilic | + |
| 37 | 0.63 | Thermosynechococcus sp. | Mesophilic | + |
| 38 | 0.63 | Crinalium epipsammum | Mesophilic | + |
| 39 | 0.63 | Cyanothece sp. | Mesophilic | − |
| 40 | 0.63 | Geitlerinema sp. | Mesophilic | + |
| 41 | 0.63 | Nostoc sp. | Mesophilic | − |
| 42 | 0.63 | Streptomyces davawensis | Mesophilic | + |
| 43 | 0.63 | Anabaena variabilis | Mesophilic | + |
| 44 | 0.63 | Oscillatoria acuminata | Mesophilic | + |
| 45 | 0.63 | Oscillatoria acuminata | Mesophilic | + |
| 46 | 0.62 | Nostoc punctiforme | Mesophilic | − |
| 47 | 0.62 | Stanieria cyanosphaera | Mesophilic | + |
| 48 | 0.62 | Cyanobacterium aponinum | Mesophilic | + |
| 49 | 0.62 | Synechococcus sp. | Thermophilic | − |
| 50 | 0.62 | Synechocystis sp. | Mesophilic | − |
| 51 | 0.62 | Acaryochloris marina | Mesophilic | − |
| 52 | 0.62 | Streptomyces fulvissimus | Mesophilic | + |
| 53 | 0.61 | Synechococcus sp. | Thermophilic | − |
| 54 | 0.61 | Synechocystis sp. | Mesophilic | − |
| 55 | 0.61 | Trichodesmium erythraeum | Mesophilic | − |
| 56 | 0.61 | Cyanobacterium stanieri | Mesophilic | + |
| 57 | 0.61 | Verrucosispora maris | Mesophilic | + |
| 58 | 0.61 | Chroococcidiopsis thermalis | Mesophilic | + |
| 59 | 0.6 | Prochlorococcus marinus | Mesophilic | − |
| 60 | 0.6 | Gloeocapsa sp. | Mesophilic | + |
| 61 | 0.6 | Rhodococcus equi | Mesophilic | + |
| 62 | 0.6 | Pseudanabaena sp. | Mesophilic | + |
| 63 | 0.6 | Corynebacterium callunae | Mesophilic | + |
| 64 | 0.6 | Prochlorococcus marinus | Mesophilic | − |
| 65 | 0.6 | Rhodococcus pyridinivorans | Mesophilic | + |
| 66 | 0.6 | Amycolicicoccus subflavus | Mesophilic | + |
| 67 | 0.59 | Mycobacterium smegmatis | Mesophilic | + |
| 68 | 0.59 | Corynebacterium efficiens | Mesophilic | + |
| 69 | 0.59 | Synechococcus sp. | Thermophilic | − |

TABLE 6-continued

| | | Urea-Binding Proteins | | |
|---|---|---|---|---|
| 70 | 0.59 | *Gordonia* sp. | Mesophilic | + |
| 71 | 0.59 | *Mycobacterium neoaurum* | Mesophilic | + |
| 72 | 0.59 | *Arthrospira platensis* | Mesophilic | − |
| 73 | 0.59 | *Mycobacterium* sp. | Mesophilic | + |
| 74 | 0.59 | *Mycobacterium vanbaalenii* | Mesophilic | + |
| 75 | 0.59 | *Mycobacterium gilvum* | Mesophilic | + |
| 76 | 0.59 | *Mycobacterium rhodesiae* | Mesophilic | + |
| 77 | 0.59 | *Rhodococcus erythropolis* | Mesophilic | + |
| 78 | 0.58 | *Corynebacterium glutamicum* | Mesophilic | + |
| 79 | 0.58 | OF INDUSTRIAL | Mesophilic | + |
| 80 | 0.58 | *Cellulomonas flavigena* | Mesophilic | + |
| 81 | 0.58 | *Mycobacterium chubuense* | Mesophilic | + |
| 82 | 0.58 | *Nocardia cyriacigeorgica* | Mesophilic | + |
| 83 | 0.58 | *Synechococcus* sp. | Thermophilic | − |
| 84 | 0.58 | *Rhodococcus opacus* | Mesophilic | + |
| 85 | 0.58 | *Rhodococcus jostii* | Mesophilic | + |
| 86 | 0.58 | *Nocardia farcinica* | Mesophilic | + |
| 87 | 0.58 | *Cyanobium gracile* | Mesophilic | + |
| 88 | 0.58 | *Calothrix* sp. | Mesophilic | + |
| 89 | 0.58 | *Bifidobacterium longum* | Mesophilic | + |
| 90 | 0.57 | *Synechococcus* sp. | Thermophilic | − |
| 91 | 0.57 | *Prochlorococcus marinus* | Mesophilic | − |
| 92 | 0.57 | *Pseudomonas mendocina* | Mesophilic | − |
| 93 | 0.57 | *Synechococcus* sp. | Thermophilic | − |
| 94 | 0.57 | *Cylindrospermum stagnale* | Mesophilic | + |
| 95 | 0.57 | *Anabaena cylindrica* | Mesophilic | + |
| 96 | 0.57 | *Acinetobacter* sp. | Mesophilic | − |
| 97 | 0.57 | *Acidovorax* sp. | Mesophilic | − |
| 98 | 0.57 | *Leptothrix cholodnii* | Mesophilic | − |
| 99 | 0.57 | *Candidatus Nitrosoarchaeum* | Mesophilic | + |
| 100 | 0.57 | *Pectobacterium wasabiae* | Mesophilic | − |
| 101 | 0.57 | *Pectobacterium carotovorum* | Mesophilic | − |
| 102 | 0.56 | *Pectobacterium* sp. | Mesophilic | − |
| 103 | 0.56 | *Prochlorococcus marinus* | Mesophilic | − |
| 104 | 0.56 | *Pseudomonas fulva* | Mesophilic | − |
| 105 | 0.56 | *Citrobacter koseri* | Mesophilic | − |
| 106 | 0.56 | *Candidatus Accumulibacter* | Mesophilic | + |
| 107 | 0.56 | *Pectobacterium carotovorum* | Mesophilic | − |
| 108 | 0.56 | *Enterobacter cloacae* | Mesophilic | − |
| 109 | 0.56 | *Verminephrobacter eiseniae* | Mesophilic | − |
| 110 | 0.56 | *Dickeya zeae* | Mesophilic | − |
| 111 | 0.56 | *Cronobacter sakazakii* | Mesophilic | − |
| 112 | 0.56 | *Magnetospirillum gryphiswalden* | Mesophilic | + |
| 113 | 0.56 | *Azoarcus* sp. | Mesophilic | − |
| 114 | 0.56 | *Pectobacterium atrosepticum* | Mesophilic | − |
| 115 | 0.55 | *Klebsiella pneumoniae* | Mesophilic | − |
| 116 | 0.55 | *Rahnella* sp. | Mesophilic | + |
| 117 | 0.55 | *Deinococcus radiodurans* | Mesophilic | + |
| 118 | 0.55 | *Cupriavidus metallidurans* | Mesophilic | − |
| 119 | 0.55 | *Pseudomonas aeruginosa* | Mesophilic | − |
| 120 | 0.55 | *Psychrobacter cryohalolentis* | Psychrophilic | − |
| 121 | 0.55 | *Pseudomonas stutzeri* | Mesophilic | − |
| 122 | 0.55 | *Dechloromonas aromatica* | Mesophilic | − |
| 123 | 0.55 | *Arcobacter butzleri* | Mesophilic | − |
| 124 | 0.55 | *Enterobacter cloacae* | Mesophilic | − |
| 125 | 0.55 | *Pseudomonas monteilii* | Mesophilic | − |
| 126 | 0.55 | *Citrobacter rodentium* | Mesophilic | − |
| 127 | 0.55 | *Albidiferax ferrireducens* | Mesophilic | + |
| 128 | 0.55 | *Ramlibacter tataouinensis* | Mesophilic | − |
| 129 | 0.55 | *Thermocrinis albus* | Thermophilic | − |
| 130 | 0.55 | *Cupriavidus necator* | Mesophilic | − |
| 131 | 0.55 | *Pantoea* sp. | Mesophilic | − |
| 132 | 0.55 | *Pantoea vagans* | Mesophilic | − |
| 133 | 0.55 | *Acidovorax avenae* | Mesophilic | − |
| 134 | 0.55 | *Polaromonas naphthalenivorans* | Mesophilic | − |
| 135 | 0.55 | *Raoultella ornithinolytica* | Mesophilic | + |
| 136 | 0.55 | *Enterobacter asburiae* | Mesophilic | − |
| 137 | 0.55 | *Klebsiella variicola* | Mesophilic | − |
| 138 | 0.55 | *Polaromonas* sp. | Mesophilic | − |
| 139 | 0.55 | *Pseudomonas putida* | Mesophilic | − |
| 140 | 0.55 | *Yersinia enterocolitica* | Mesophilic | − |
| 141 | 0.55 | *Serratia plymuthica* | Mesophilic | + |
| 142 | 0.55 | *Cronobacter sakazakii* | Mesophilic | − |
| 143 | 0.55 | *Pantoea ananatis* | Mesophilic | − |
| 144 | 0.55 | *Rubrivivax gelatinosus* | Mesophilic | + |
| 145 | 0.55 | *Rahnella aquatilis* | Mesophilic | + |
| 146 | 0.55 | *Klebsiella oxytoca* | Mesophilic | − |
| 147 | 0.55 | *Cytophaga hutchinsonii* | Mesophilic | − |

TABLE 6-continued

| | | Urea-Binding Proteins | | |
|---|---|---|---|---|
| 148 | 0.55 | *Pseudomonas aeruginosa* | Mesophilic | − |
| 149 | 0.55 | *Pseudanabaena* sp. | Mesophilic | + |
| 150 | 0.55 | *Pseudomonas stutzeri* | Mesophilic | − |
| 151 | 0.55 | *Erwinia billingiae* | Mesophilic | − |
| 152 | 0.55 | *Pseudomonas monteilii* | Mesophilic | − |
| 153 | 0.55 | *Serratia liquefaciens* | Mesophilic | + |
| 154 | 0.55 | *Enterobacter* sp. | Mesophilic | − |
| 155 | 0.55 | *Pseudomonas denitrificans* | Mesophilic | − |
| 156 | 0.55 | *Klebsiella pneumoniae* | Mesophilic | − |
| 157 | 0.55 | *Burkholderia vietnamiensis* | Mesophilic | − |
| 158 | 0.55 | *Enterobacteriaceae bacterium* | Mesophilic | + |
| 159 | 0.55 | *Pseudomonas protegens* | Mesophilic | − |
| 160 | 0.55 | *Cupriavidus taiwanensis* | Mesophilic | − |
| 161 | 0.55 | *Pseudomonas fluorescens* | Mesophilic | − |
| 162 | 0.55 | *Psychrobacter* sp. | Mesophilic | − |
| 163 | 0.55 | *Burkholderia ambifaria* | Mesophilic | − |
| 164 | 0.55 | *Cronobacter turicensis* | Mesophilic | − |
| 165 | 0.55 | *Pseudomonas resinovorans* | Mesophilic | − |
| 166 | 0.55 | *Ralstonia pickettii* | Mesophilic | − |
| 167 | 0.54 | *Arcobacter butzleri* | Mesophilic | − |
| 168 | 0.54 | *Pseudomonas putida* | Mesophilic | − |
| 169 | 0.54 | *Serratia* sp. | Mesophilic | + |
| 170 | 0.54 | *Yersinia pestis* | Mesophilic | − |
| 171 | 0.54 | *Yersinia pseudotuberculosis* | Mesophilic | − |
| 172 | 0.54 | *Serratia plymuthica* | Mesophilic | + |
| 173 | 0.54 | *Alcanivorax dieselolei* | Mesophilic | + |
| 174 | 0.54 | *Ralstonia solanacearum* | Mesophilic | − |
| 175 | 0.54 | *Serratia proteamaculans* | Mesophilic | + |
| 176 | 0.54 | *Pseudomonas mendocina* | Mesophilic | − |
| 177 | 0.54 | *Ralstonia eutropha* | Mesophilic | − |
| 178 | 0.54 | *Klebsiella oxytoca* | Mesophilic | − |
| 179 | 0.54 | *Pseudomonas entomophila* | Mesophilic | − |
| 180 | 0.54 | *Serratia marcescens* | Mesophilic | + |
| 181 | 0.54 | *Azoarcus* sp. | Mesophilic | − |
| 182 | 0.54 | *Acidovorax citrulli* | Mesophilic | − |
| 183 | 0.54 | *Pseudomonas aeruginosa* | Mesophilic | − |
| 184 | 0.54 | *Pseudomonas syringae* | Mesophilic | − |
| 185 | 0.54 | *Pseudomonas stutzeri* | Mesophilic | − |
| 186 | 0.54 | *Methylocella silvestris* | Mesophilic | − |
| 187 | 0.54 | *Pseudomonas brassicacearum* | Mesophilic | − |
| 188 | 0.54 | *Burkholderia* sp. | Mesophilic | − |
| 189 | 0.54 | *Arcobacter* sp. | Mesophilic | − |
| 190 | 0.54 | *Klebsiella pneumoniae* | Mesophilic | − |
| 191 | 0.54 | *Burkholderia multivorans* | Mesophilic | − |
| 192 | 0.54 | *Burkholderia cepacia* | Mesophilic | − |
| 193 | 0.54 | *Variovorax paradoxus* | Mesophilic | − |
| 194 | 0.54 | *Burkholderia lata* | Mesophilic | − |
| 195 | 0.54 | *Bordetella petrii* | Mesophilic | − |
| 196 | 0.54 | *Erwinia tasmaniensis* | Mesophilic | − |
| 197 | 0.54 | *Pseudomonas* sp. | Mesophilic | − |
| 198 | 0.54 | *Burkholderia cenocepacia* | Mesophilic | − |
| 199 | 0.54 | *Burkholderia phymatum* | Mesophilic | − |
| 200 | 0.54 | *Ralstonia solanacearum* | Mesophilic | − |
| 201 | 0.54 | *Pseudomonas protegens* | Mesophilic | − |
| 202 | 0.54 | *Serratia marcescens* | Mesophilic | + |
| 203 | 0.54 | *Pseudomonas poae* | Mesophilic | − |
| 204 | 0.54 | *Pseudomonas fluorescens* | Mesophilic | − |
| 205 | 0.54 | *Pseudomonas aeruginosa* | Mesophilic | − |
| 206 | 0.54 | *Burkholderia ambifaria* | Mesophilic | − |
| 207 | 0.54 | *Pseudomonas syringae* | Mesophilic | − |
| 208 | 0.54 | *Ralstonia pickettii* | Mesophilic | − |
| 209 | 0.54 | *Pseudomonas stutzeri* | Mesophilic | − |
| 210 | 0.54 | *Achromobacter xylosoxidans* | Mesophilic | − |
| 211 | 0.54 | *Salmonella enterica* | Mesophilic | − |
| 212 | 0.54 | *Thauera* sp. | Mesophilic | − |
| 213 | 0.54 | *Teredinibacter turnerae* | Mesophilic | − |
| 214 | 0.54 | *Tolumonas auensis* | Mesophilic | − |
| 215 | 0.54 | *Novosphingobium* sp. | Mesophilic | − |
| 216 | 0.54 | *Methylibium petroleiphilum* | Mesophilic | − |
| 217 | 0.53 | *Burkholderia* sp. | Mesophilic | − |
| 218 | 0.53 | *Burkholderia pseudomallei* | Mesophilic | − |
| 219 | 0.53 | *Ralstonia solanacearum* | Mesophilic | − |
| 220 | 0.53 | *Methylobacterium nodulans* | Mesophilic | − |
| 221 | 0.53 | *Collimonas fungivorans* | Mesophilic | − |
| 222 | 0.53 | *Xanthobacter autotrophicus* | Mesophilic | − |
| 223 | 0.53 | *Alteromonas macleodii* | Mesophilic | − |
| 224 | 0.53 | *Thiocystis violascens* | Mesophilic | + |
| 225 | 0.53 | *Pandoraea pnomenusa* | Mesophilic | + |

TABLE 6-continued

| Urea-Binding Proteins | | | | |
|---|---|---|---|---|
| 226 | 0.53 | *Alcanivorax borkumensis* | Mesophilic | + |
| 227 | 0.53 | *Azoarcus* sp. | Mesophilic | − |
| 228 | 0.53 | *Phycisphaera mikurensis* | Mesophilic | + |
| 229 | 0.53 | *Burkholderia mallei* | Mesophilic | − |
| 230 | 0.53 | *Arcobacter nitrofigilis* | Mesophilic | − |
| 231 | 0.53 | *Burkholderia* sp. | Mesophilic | − |
| 232 | 0.53 | *Achromobacter xylosoxidans* | Mesophilic | − |
| 233 | 0.53 | *Burkholderia pseudomallei* | Mesophilic | − |
| 234 | 0.53 | *Pandoraea* sp. | Mesophilic | + |
| 235 | 0.53 | *Marinomonas* sp. | Mesophilic | − |
| 236 | 0.53 | *Burkholderia glumae* | Mesophilic | − |
| 237 | 0.53 | *Rhodospirillum photometricum* | Mesophilic | + |
| 238 | 0.53 | *Psychromonas ingrahamii* | Psychrophilic | − |
| 239 | 0.53 | *Rhizobium leguminosarum* | Mesophilic | − |
| 240 | 0.53 | *Burkholderia gladioli* | Mesophilic | − |
| 241 | 0.53 | *Burkholderia thailandensis* | Mesophilic | − |
| 242 | 0.52 | *Methylobacterium radiotolerans* | Mesophilic | − |
| 243 | 0.52 | *Rhodobacter capsulatus* | Mesophilic | − |
| 244 | 0.52 | *Hahella chejuensis* | Mesophilic | − |
| 245 | 0.52 | *Alteromonas macleodii* | Mesophilic | − |
| 246 | 0.52 | *Alteromonas* sp. | Mesophilic | − |
| 247 | 0.52 | *Pseudovibrio* sp. | Mesophilic | + |
| 248 | 0.52 | *Janthinobacterium* sp. | Mesophilic | − |
| 249 | 0.52 | *Alkalilimnicola ehrlichii* | Mesophilic | − |
| 250 | 0.52 | *Burkholderia mallei* | Mesophilic | − |
| 251 | 0.52 | *Saccharophagus degradans* | Mesophilic | − |
| 252 | 0.52 | *Cellvibrio japonicus* | Mesophilic | − |
| 253 | 0.52 | *Glaciecola psychrophila* | Mesophilic | + |
| 254 | 0.52 | *Phaeobacter gallaeciensis* | Mesophilic | + |
| 255 | 0.52 | *Rhizobium tropici* | Mesophilic | − |
| 256 | 0.52 | *Bradyrhizobium* sp. | Mesophilic | − |
| 257 | 0.52 | *Rhodopseudomonas palustris* | Mesophilic | − |
| 258 | 0.52 | *Methylobacterium* sp. | Mesophilic | − |
| 259 | 0.52 | *Herbaspirillum seropedicae* | Mesophilic | − |
| 260 | 0.52 | *Azospirillum lipoferum* | Mesophilic | + |
| 261 | 0.52 | *Halomonas elongata* | Mesophilic | − |
| 262 | 0.52 | *Hirschia baltica* | Mesophilic | − |
| 263 | 0.52 | *Azospirillum* sp. | Mesophilic | + |
| 264 | 0.52 | *Rhizobium leguminosarum* | Mesophilic | − |
| 265 | 0.52 | *Shewanella sediminis* | Psychrophilic | − |
| 266 | 0.52 | *Marinomonas posidonica* | Mesophilic | − |
| 267 | 0.52 | *Advenella kashmirensis* | Mesophilic | + |
| 268 | 0.52 | *Burkholderia* sp. | Mesophilic | − |
| 269 | 0.52 | *Sinorhizobium meliloti* | Mesophilic | − |
| 270 | 0.52 | *Sinorhizobium meliloti* | Mesophilic | − |
| 271 | 0.52 | *Burkholderia xenovorans* | Mesophilic | − |
| 272 | 0.52 | *Mesorhizobium opportunistum* | Mesophilic | − |
| 273 | 0.52 | *Sinorhizobium fredii* | Mesophilic | − |
| 274 | 0.52 | *Sinorhizobium medicae* | Mesophilic | − |
| 275 | 0.52 | *Magnetospirillum gryphiswalden* | Mesophilic | + |
| 276 | 0.52 | *Rhodospirillum photometricum* | Mesophilic | + |
| 277 | 0.52 | *Marinomonas mediterranea* | Mesophilic | − |
| 278 | 0.52 | *Rhizobium* sp. | Mesophilic | − |
| 279 | 0.52 | *Thalassolituus oleivorans* | Mesophilic | + |
| 280 | 0.52 | *Bradyrhizobium diazoefficiens* | Mesophilic | − |
| 281 | 0.52 | *Paracoccus denitrificons* | Mesophilic | − |
| 282 | 0.52 | *Vibrio* sp. | Mesophilic | + |
| 283 | 0.52 | *Agrobacterium fabrum* | Mesophilic | − |
| 284 | 0.52 | *Polymorphum gilvum* | Mesophilic | − |
| 285 | 0.52 | *Sinorhizobium fredii* | Mesophilic | − |
| 286 | 0.52 | *Azospirillum brasilense* | Mesophilic | + |
| 287 | 0.52 | *Burkholderia phytofirmans* | Mesophilic | − |
| 288 | 0.52 | *Agrobacterium radiobacter* | Mesophilic | − |
| 289 | 0.52 | *Mesorhizobium ciceri* | Mesophilic | − |
| 290 | 0.52 | *Marinobacter* sp. | Mesophilic | + |
| 291 | 0.52 | *Methylomonas methanica* | Mesophilic | − |
| 292 | 0.51 | *Burkholderia* sp. | Mesophilic | − |
| 293 | 0.51 | *Bradyrhizobium japonicum* | Mesophilic | − |
| 294 | 0.51 | *Burkholderia phenoliruptrix* | Mesophilic | − |
| 295 | 0.51 | *Sinorhizobium fredii* | Mesophilic | − |
| 296 | 0.51 | *Rhizobium etli* | Mesophilic | − |
| 297 | 0.51 | *Agrobacterium* sp. | Mesophilic | − |
| 298 | 0.51 | *Rhizobium leguminosarum* | Mesophilic | − |
| 299 | 0.51 | *Azorhizobium caulinodans* | Mesophilic | − |
| 300 | 0.51 | *Mesorhizobium loti* | Mesophilic | − |
| 301 | 0.51 | *Marinobacter aquaeolei* | Mesophilic | + |
| 302 | 0.51 | *Marinobacter hydrocarbonoclast* | Mesophilic | + |
| 303 | 0.51 | *Mesorhizobium australicum* | Mesophilic | − |

TABLE 6-continued

Urea-Binding Proteins

| | | | | |
|---|---|---|---|---|
| 304 | 0.51 | *Sinorhizobium meliloti* | Mesophilic | − |
| 305 | 0.51 | *Phaeobacter gallaeciensis* | Mesophilic | + |
| 306 | 0.51 | *Bradyrhizobium oligotrophicum* | Mesophilic | − |
| 307 | 0.51 | *Polynucleobacter necessarius* | Mesophilic | − |
| 308 | 0.51 | *Rhodopseudomonas palustris* | Mesophilic | − |
| 309 | 0.51 | *Halothiobacillus neapolitanus* | Mesophilic | − |
| 310 | 0.51 | *Bradyrhizobium* sp. | Mesophilic | − |
| 311 | 0.51 | *Rhodobacter sphaeroides* | Mesophilic | − |
| 312 | 0.51 | *Agrobacterium vitis* | Mesophilic | − |
| 313 | 0.51 | *Magnetococcus marinus* | Mesophilic | + |
| 314 | 0.51 | *Acetobacter pasteurianus* | Mesophilic | − |
| 315 | 0.51 | *Tistrella mobilis* | Mesophilic | + |
| 316 | 0.51 | *Cycloclasticus* sp. | Mesophilic | + |
| 317 | 0.51 | *Candidatus Azobacteroides* | Mesophilic | + |
| 318 | 0.51 | *Ruegeria pomeroyi* | Mesophilic | − |
| 319 | 0.51 | *Chromohalobacter salexigens* | Mesophilic | − |
| 320 | 0.51 | *Cycloclasticus zancles* | Mesophilic | + |
| 321 | 0.51 | *Rhizobium etli* | Mesophilic | − |
| 322 | 0.51 | *Rhodopseudomonas palustris* | Mesophilic | − |
| 323 | 0.51 | *Comamonas testosteroni* | Mesophilic | − |
| 324 | 0.5 | *Vibrio nigripulchritudo* | Mesophilic | + |
| 325 | 0.5 | *Rhodobacter sphaeroides* | Mesophilic | − |
| 326 | 0.5 | *Starkeya novella* | Mesophilic | − |
| 327 | 0.5 | *Acetobacter pasteurianus* | Mesophilic | − |
| 328 | 0.5 | *Rhodopseudomonas palustris* | Mesophilic | − |
| 329 | 0.5 | *Shewanella woodyi* | Mesophilic | − |
| 330 | 0.5 | *Opitutus terrae* | Mesophilic | − |
| 331 | 0.5 | *Roseobacter denitrificans* | Mesophilic | − |
| 332 | 0.5 | *Roseobacter litoralis* | Mesophilic | − |
| 333 | 0.49 | *Planctomyces brasiliensis* | Mesophilic | − |
| 334 | 0.49 | *Dinoroseobacter shibae* | Mesophilic | − |
| 335 | 0.49 | *Marinobacter adhaerens* | ? | + |
| 336 | 0.49 | *Gallionella capsiferriformans* | Mesophilic | − |
| 337 | 0.49 | *Methanobacterium* sp. | ? | N/a |
| 338 | 0.49 | *Ketogulonicigenium vulgare* | Mesophilic | − |
| 339 | 0.49 | *Candidatus Nitrosopumilus* | Mesophilic | + |
| 340 | 0.49 | *Spiribacter salinus* | Mesophilic | + |
| 341 | 0.48 | *Sulfuricella denitrificans* | Mesophilic | + |
| 342 | 0.48 | *Methanobacterium* sp. | ? | N/a |
| 343 | 0.48 | *Pelagibacterium halotolerans* | Mesophilic | + |
| 344 | 0.48 | *Octadecabacter antarcticus* | Mesophilic | + |
| 345 | 0.48 | *Octadecabacter arcticus* | Mesophilic | + |
| 346 | 0.48 | *Coraliomargarita akajimensis* | Mesophilic | − |
| 347 | 0.46 | *Methylomicrobium alcaliphilum* | Mesophilic | + |
| 348 | 0.46 | *Haliangium ochraceum* | Mesophilic | − |
| 349 | 0.43 | *Synechococcus* sp. | Thermophilic | − |

Figure 5C:
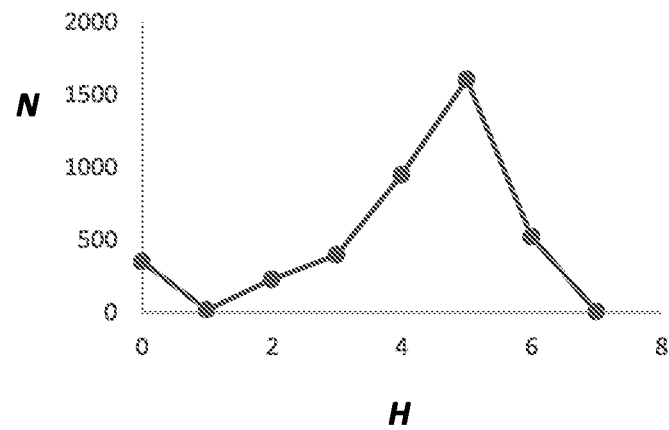

The distribution of Hamming distance values (FIG. 5C) shows that sequences are either members of the UBP functional family (H=0), or not (H>1), but very few are intermediate (H=1). This behavior reflects a selective pressure that ensures ligand-binding specificity. From a practical point of view, it confirms the reliability of the SAFE method.

Example 5

Sensor Engineering Phase 4: Cysteine Mutant Scans and Fluorophore Screening to Identify Fluorescently Responsive Urea Sensors Semi-synthetic FRSs can be engineered by site-specifically attaching thiol-reactive, environmentally sensitive fluorophores that respond to ligand-mediated conformational changes. Identification of FRS candidates that can be used for sensing applications comprises four steps:
1. Cysteine scan. Mutant urea-binding proteins containing single cysteines are constructed for site-specific attachment of thiol-reactive fluorophores. General structural principles have been established to identify positions in PBPs where attached single fluorophores are likely to exhibit ligand-dependent responses (de Lorimier et al., 2002, *Protein Sci*, 11, 2655-75). Candidate positions fall into three classes: endosteric, replacing a residue that contacts the ligand directly; peristeric, located at the rim of the binding site; allosteric (Marvin et al., 1997, *Proc Natl Acad Sci USA*, 94, 4366-71; Marvin, 1998, *J Am Chem Soc*, 120, 7-11), located outside the binding site at sites that undergo local structural changes in concert with the hinge-bending motion.
2. Fluorophore screening. Thiol-reactive, environmentally sensitive fluorophores are attached to each cysteine mutant prepared in step 1.
3. Evaluation of the urea-mediated change of all the fluorescent conjugates prepared in step 2. Responses to ligand binding in which there is both a change in fluorescence emission intensity and spectral shape are essential for chemometric applications, because such changes enable ratiometric measurements. Changes in spectral shape typically are accompanied by a shift in the wavelength of the emission intensity maxima. Three classes of fluorescent responses are possible:
    i. No response.
    ii. Monochromatic response (emission intensity increases or decreases without a change in spectral shape)

iii. Dichromatic response (both intensity and spectral shape changes) which can be classified into two sub-classes:
i. Hypsochromatic: emission intensity shifts to shorter wavelengths upon binding ligand ("blue shift").
ii. Bathochromatic: emission intensity shifts to longer wavelengths upon binding ligand ("red shift").
4. Double labeling strategies to convert monochromatic responses into dichromatic signals, or to improve upon weak dichromatic responses.

Figure 9:
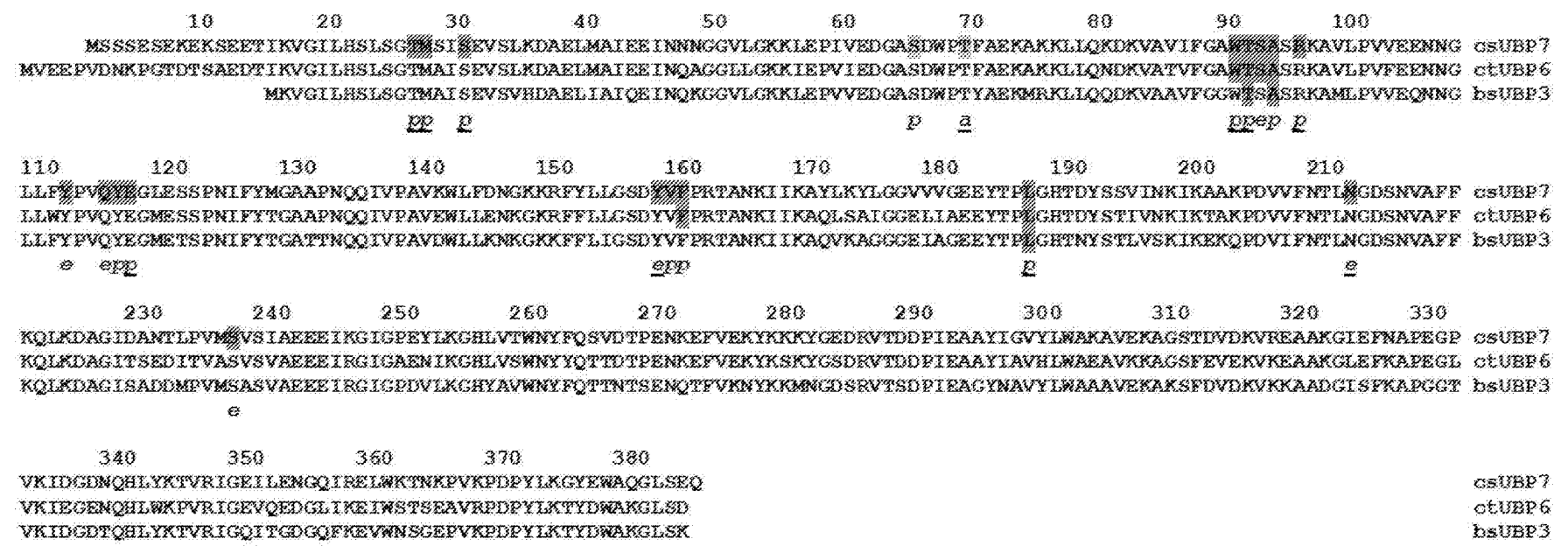
Figure 11A:
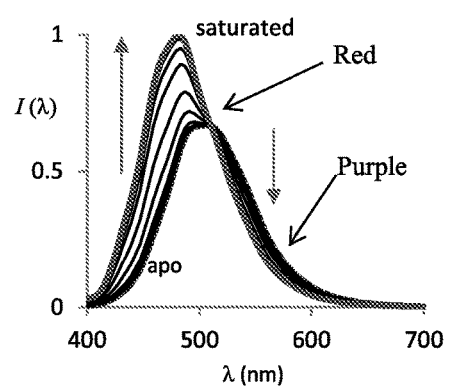
FIGS. 11A-C are graphs showing that csUBP7 95C·Badan conjugate exhibits a dichromatic response to urea.
Figure 11B:
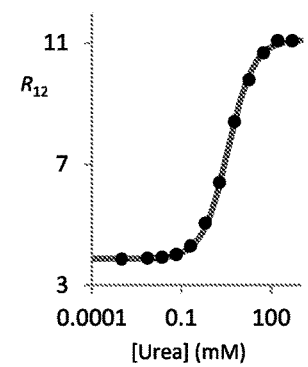
Figure 11C:
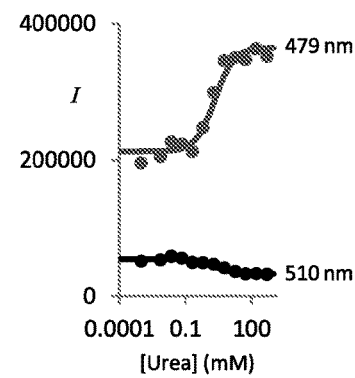
Figure 12A:
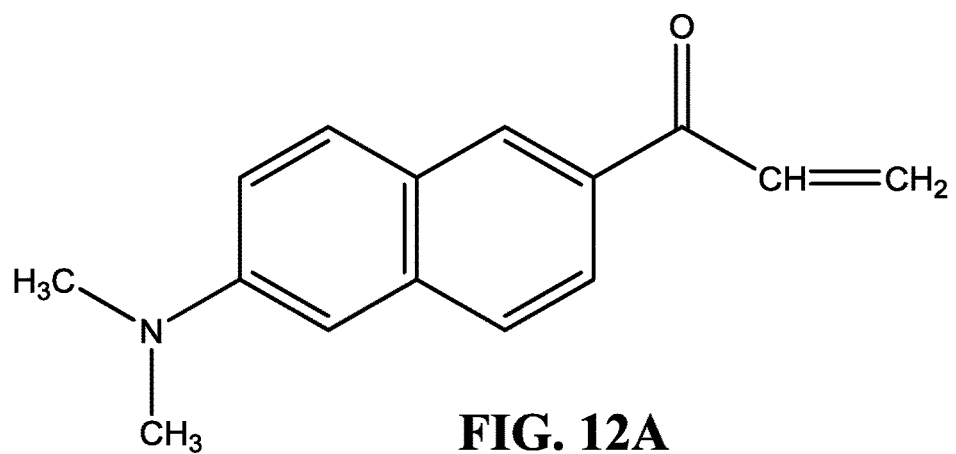
FIGS. 12A-P are depictions of fluorophore chemical structures. Naphthalene family: A, Acrylodan; B, Badan; C, IAEDANS. Xanthene family: D, Fluorescein (5-IAF and 6-IAF); E, Oregon Green; F, Alexa 432; G, Alexa 532; H, Alexa 546; I, Texas Red. Coumarin family: J, Pacific Blue; K, CPM. benzoxadiazole family: L, IANBD. Boradiazaindacine (BODIPY) family: M, BODIPY 499/508; N, BODIPY 507/545. Cyanine family: O, Cy5. Miscellaneous: P, PyMPO.
Figure 12B:
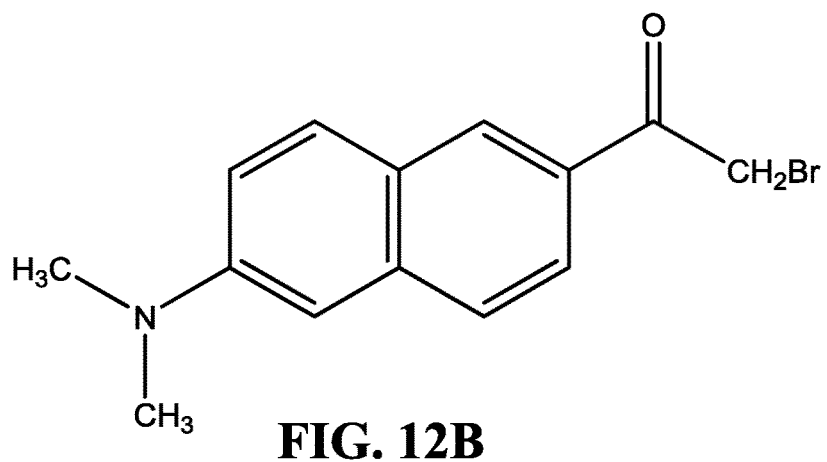
FIG. 12B: Inter-dipole geometry. Top, FRET efficiency (f=$Q_r/(Q_0-Q_\infty)$, where the $Q_r$, $Q_0$, $Q_\infty$ are the quantum efficiencies at distances r, closest approach, and infinity, respectively) varies as the $6^{th}$ power of the distance between two dipoles. Bottom, FRET efficiency varies as the square of the orientation factor κ, where κ=sin $\theta_D$ sin $\theta_A$ cos χ−2 cos $\theta_D$ cos $\theta_A$ with $\theta_D$ and $\theta_A$ the angles of the donor (blue) and acceptor (red) electronic transition dipoles with the line connecting them, and χ the angle between the planes within which they lie.
Figure 12C:
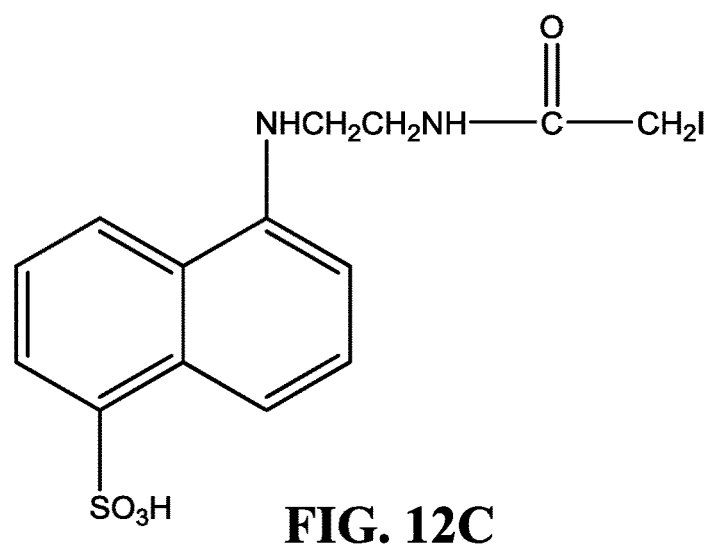
FIG. 12C: Spectral overlap (grey area) between the donor fluorescence emission ($^DI$, blue) and acceptor fluorescence excitation ($^4A$, black) spectra. This overlap increases with bathochromic or hypsochromic shifts of the donor emission (red arrow) and acceptor excitation (dotted blue arrow) spectra, respectively. Shifts in the opposite directions decreases spectral overlap.
Figure 12D:
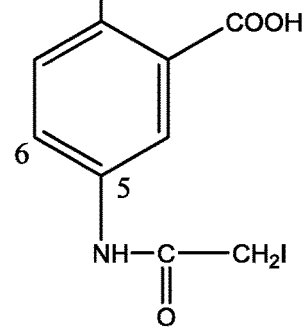
Figure 12E:
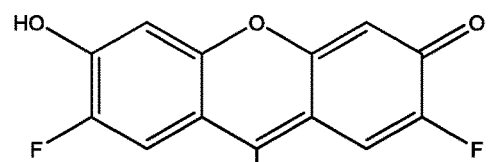
Figure 12F:
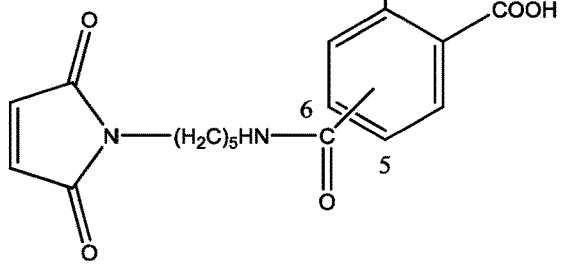
Figure 12J:
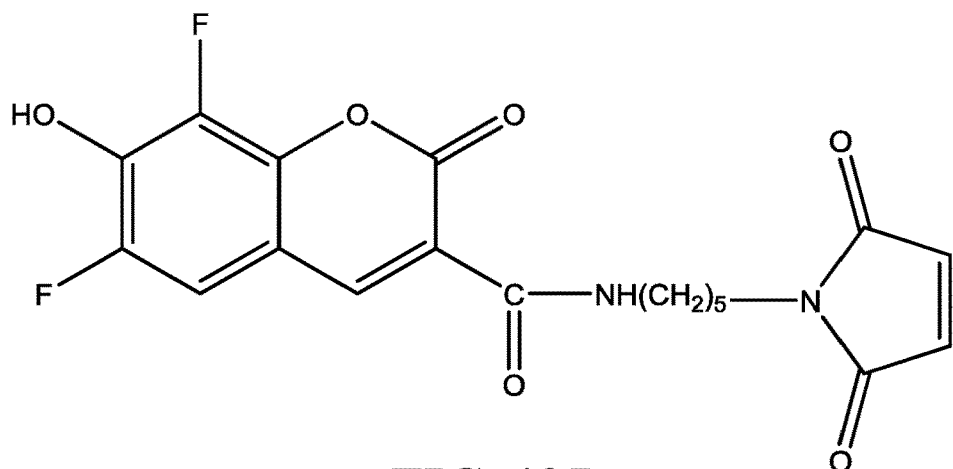
Figure 12K:
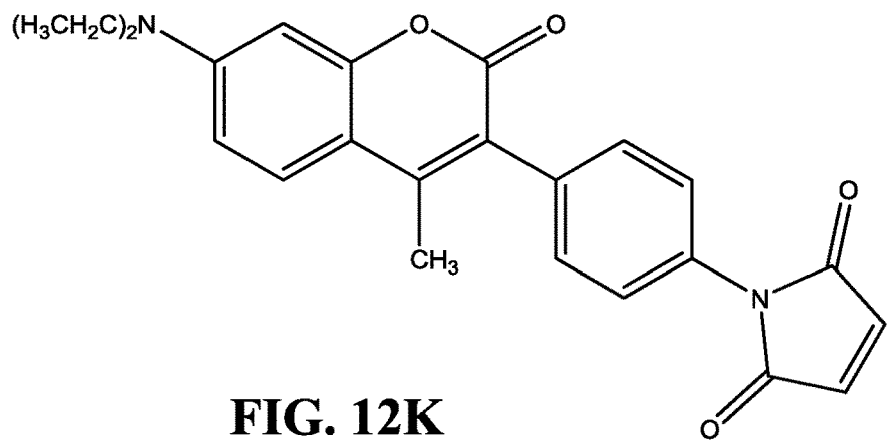
Figure 12L:
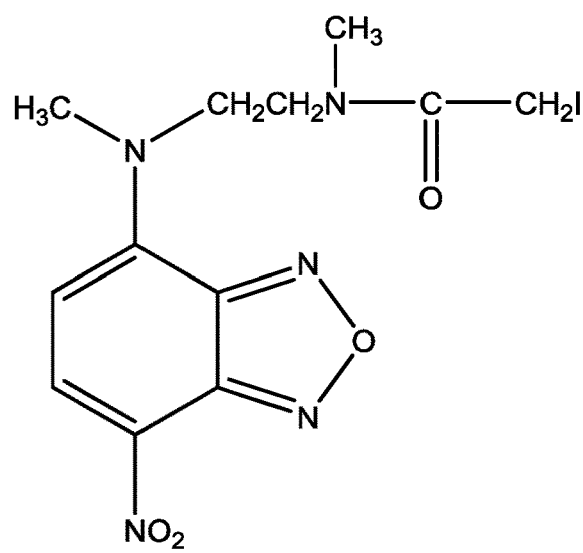
Figure 12M:
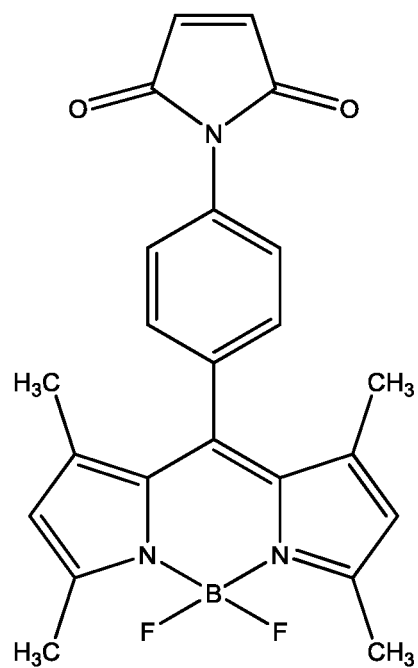
Figure 12N:
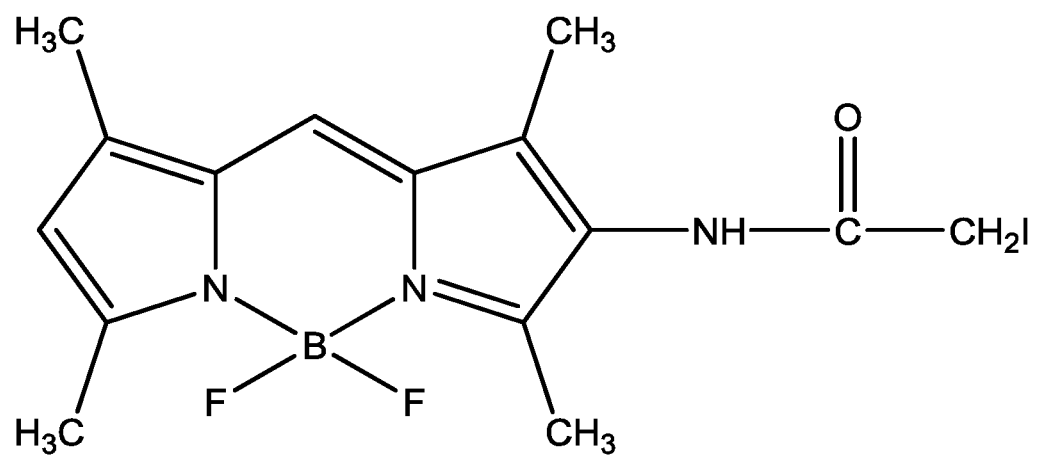
Figure 12O:
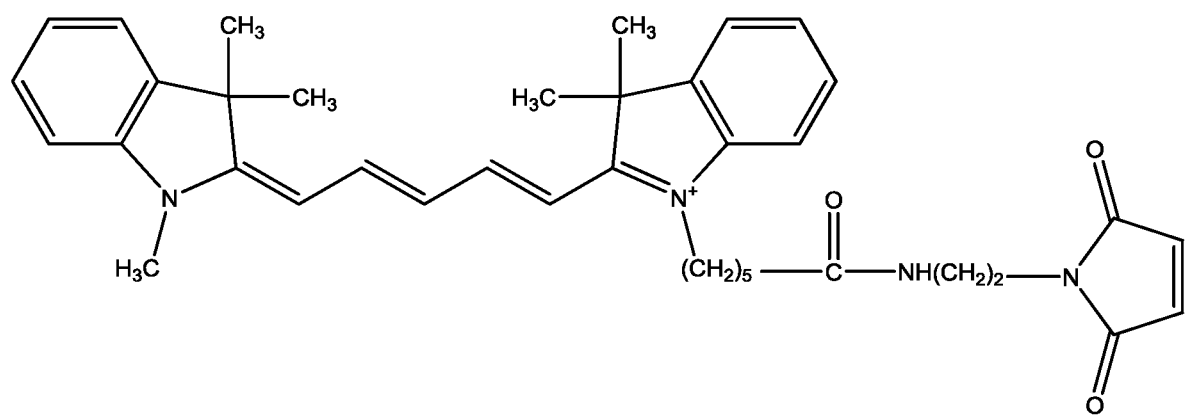
Figure 12P:
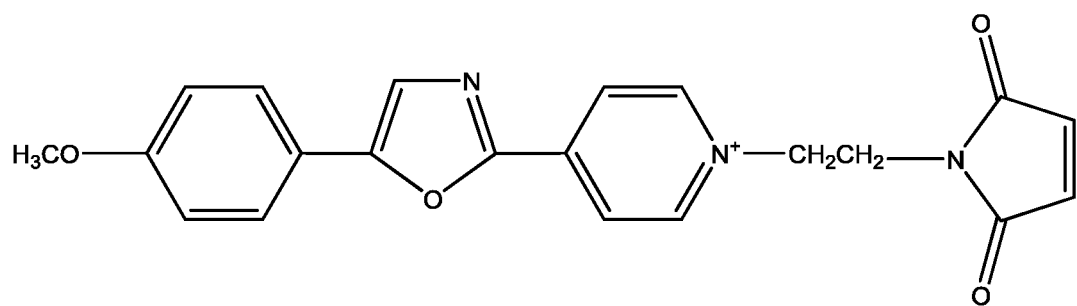
Figure 13A:
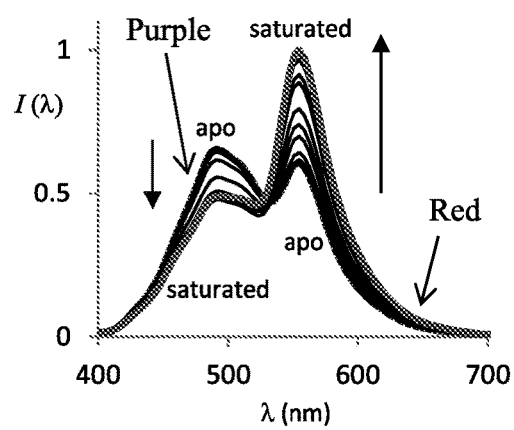
FIGS. 13A, C, and D are graphs
Figure 13B:
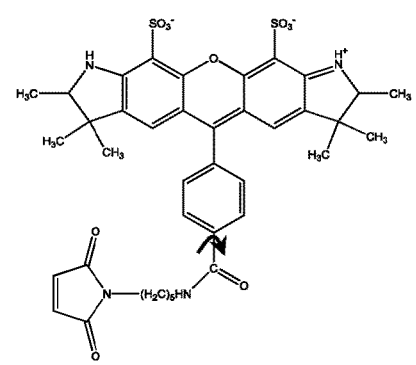
FIG. 13B is a depiction of a chemical structure, each of which relate to the urea response of the dually labeled csUBP7 Q114A 186C·Alexa532 βZif·Acrylodan conjugates. In this ngmFRET system, Alexa532 is the environmentally responsive acceptor, and Acrylodan the donor.
Figure 13C:
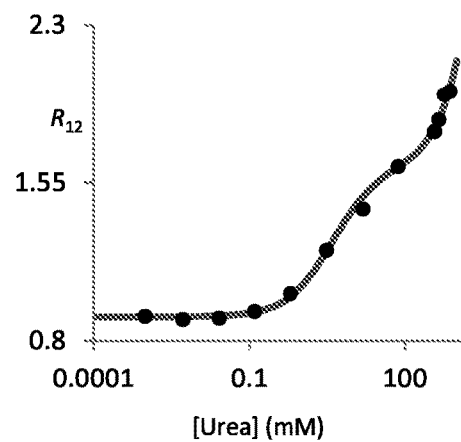
FIG. 13C: Dichromatic signal ($\lambda_1$=491 nm, $\lambda_2$=555 nm; black circles, experimental data points; gray lines, fit to binding isotherm, $^{app}K_d$=2.0 mM).
Figure 13D:
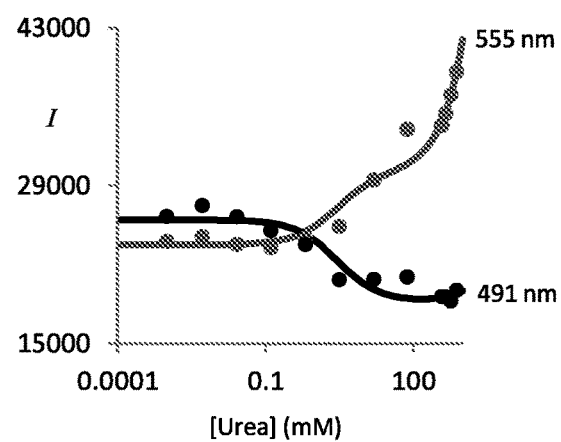
FIG. 13D: Monochromatic signal (black, 491 nm data points and fit; gray, 555 nm data points and fit; $^{true}K_d$=2.6 mM).

We constructed 20 single cysteine mutants in csUBP7, exploring 7 endosteric, 12 peristeric, and 1 allosteric position (FIG. 9). At each position we attached the Prodan-derived fluorophores Acrylodan and Badan, which differ by one methylene group in their thiol-reactive linker. The fluorescent responses of these conjugates was determined initially as a function of urea concentration and temperature (FIG. 10). This thermal landscape analysis showed that 13 of these positions, representing all three classes of attachment sites, exhibited a fluorescent response to urea binding for at least one conjugate (Table 7). The ligand dependence of the emission spectra shapes was determined for these conjugates (Table 8). At least one conjugate at 11 of the 13 positions exhibited a dichromatic response, suitable for ratiometric measurements (see FIG. 11 for an example). In the dichromatic responses of the Acrylodan or Badan conjugates, ligand-mediated changes in emission intensity spectral shapes arise from redistribution of the populations of 'blue' and 'green' emission states (Table 8), corresponding to distinct excited state transition dipoles. Such a redistribution does not occur in monochromatic responses.

TABLE 7

Response of bsUBP3, ctUBP6, and csUBP7 Acrylodan and Badan conjugates[a].

| Homolog | Position | Class | Conjugate[b] | Response[c] |
|---|---|---|---|---|
| bsUBP3 | T77C | p | A | y |
|  | A79C | p | A | y |
|  | L172C | p | A | y |
| ctUBP6 | W95C | p | A | y |
|  | T96C | p | A | n |
|  | S97C | e | A | n |

TABLE 7-continued

Response of bsUBP3, ctUBP6, and csUBP7 Acrylodan and Badan conjugates[a].

| Homolog | Position | Class | Conjugate[b] | Response[c] |
|---|---|---|---|---|
|  | A98C | p | A | y |
|  | F164C | e | A | y |
|  | L191C | p | A | y |
| csUBP7 | T26C | p | A | y |
|  |  |  | B | y |
|  | M27C | p | A | y |
|  |  |  | B | y |
|  | S30C | p | A | y |
|  |  |  | B | y |
|  | S65C | p | A | n |
|  |  |  | B | y |
|  | T69C | a | A | n |
|  |  |  | B | y |
|  | W90C | p | A | y |
|  |  |  | B | y |
|  | T91C | p | A | n |
|  |  |  | B | y |
|  | S92C | e | A | n |
|  |  |  | B | n |
|  | A93C | p | A | y |
|  |  |  | B | n |
|  | R95C | p | A | y |
|  |  |  | B | y |
|  | Y111C | e | A | n |
|  |  |  | B | n |
|  | Q114C | e | A | n |
|  |  |  | B | n |
|  | Y115C | p | A | n |
|  |  |  | B | n |
|  | E116C | p | A | y |
|  |  |  | B | y |
|  | Y157C | e | A | y |
|  |  |  | B | y |
|  | V158C | p | A | n |
|  |  |  | B | n |
|  | F159C | e | A | n |
|  |  |  | B | n |
|  | L186C | p | A | y |
|  |  |  | B | n |
|  | N211C | e | A | y |
|  |  |  | B | y |
|  | S238C | e | A | n |
|  |  |  | B | n |

[a]Measured in a Roche LightCycler (see Materials and methods).
[b]A, Acrylodan; B, Badan.
[c]y, yes; n, no.

TABLE 8

Responses of Acrylodan and Badan csUBP7 conjugates[a].

| | | | Responses | | | | | | |
|---|---|---|---|---|---|---|---|---|---|
| | | | Acrylodan | | | | Badan | | |
| Position[b] | Class[c] | Shape[d] | Intensity[e] | Dipoles[f] | $^{true}K_d$ (mM)[g] | Shape[d] | Intensity[e] | Dipoles[f] | $^{true}K_d$ (mM) |
| T26C | p | d | − | b→g | 0.09 | m | − | b/g | 0.3 |
| M27C | p | m | + | g | 4.6 | d | − | g→b/g | 3.2 |
| S30C | p | d | + | b/g→b | 5.2 | d | + | g→b | 0.3 |
| T69C | a | 0 |  | g |  | d | − | g→b/g | 0.007 |
| W90C | p | d | + | b/g→b | 7.1 | m | + | b/g | 8.5 |
| T91C | p | m | − | b/g | 0.7 | d | − | b/g→b | 0.6 |
| R95C | p | m | − | b | 0.3 | d | + | g→b | 2.2 |
| E116C | p | d | + | b/g→g | 29 | m | − | b/g | 10 |

TABLE 8-continued

Responses of Acrylodan and Badan csUBP7 conjugates[a].

| | | Responses | | | | | | |
|---|---|---|---|---|---|---|---|---|
| | | Acrylodan | | | | Badan | | |
| Position[b] | Class[c] | Shape[d] | Intensity[e] | Dipoles[f] | $^{true}K_d$ (mM)[g] | Shape[d] | Intensity[e] | Dipoles[f] | $^{true}K_d$ (mM) |
| Y157C | e | m | + | p | 3.4 | m | + | b/g | 16 |
| L186C | p | d | − | b/g→g | 0.4 | 0 | | g | |
| N211C | e | 0 | | g | | d | + | g→b/g | 15 |

[a]Determined by fitting the ratiometric signal of the intensities measured at λ1 and λ2 to equation 1-6.
[b]The PCS comprises S92, Y111, V113, Q114, Y157, F159, N211, S238.
[c]a, allosteric; e, endosteric; p, peristeric.
[d]m, monochromatic; d, dichromatic (i.e. spectral shape changes); 0, no change.
[e]+, increases in response to urea; −, decreases; 0, no change.
[f]Estimated change in populations of major emission bands: blue, (maxima <500 nm); g, green (maxima >500 nm); b/g, mixed population.

We also constructed a cysteine scan at several equivalent positions in the bsUPB3 and ctUBP6 homologs (FIG. 9) and evaluated the urea responses of Acrylodan or Badan conjugates using thermal melts (Table 7). Ligand-dependent shifts in emission intensity wavelengths were determined for a subset of these mutants (Table 9). In all three homologs that were tested, equivalent residue positions in the sequence alignment exhibited similar responses, consistent with structural conservation and generality of the coupling mechanisms within this family of proteins.

TABLE 9

Urea response of Acrylodan and Badan conjugates in a cysteine scan of the ctUBP6 scaffold.

| | | | | Emission wavelength (nm) | | $K_d^{d,e}$ (mM) | |
|---|---|---|---|---|---|---|---|
| Mutation | Class[a] | Shape[b] | Conjugate[c] | λ1 | λ2 | $^{app}K_d$ | $^{true}K_d$ |
| W95C | p | m | A | 483 | 505 | 2.4 | 2.3 |
| | | m | B | 487 | 515 | 2.5 | 2.7 |
| T96C | p | d | A | 491 | 465 | 0.52 | 0.49 |
| | | d | B | 505 | 545 | 0.62 | 0.50 |
| S97C | e | m | A | 515 | 535 | 79 | 84 |
| | | m/d | B | 526 | 539 | 69 | 95 |
| A98C | p | m | A | 515 | 485 | nb | nb |
| | | m | B | 535 | 550 | 540[d] | 440[d] |
| F164C | e | d | A | 491 | 536 | 23 | 22 |
| | | d | B | 494 | 550 | 9.4 | 11 |
| L191C | p | m | A | 499 | 545 | 0.15 | 0.11 |
| | | m | B | 531 | 560 | 0.31[d] | 0.34[d] |

[a]a, allosteric; e, endosteric; p, peristeric.
[b]m, monochromatic; d, dichromatic (i.e. spectral shape change).
[c]A, Acrylodan; B, Badan.
[d]noisy data and or bad fit.
[e]nb; no binding, nd; not determined.

In the csUBP7 homolog, we further tested the urea responses of several other fluorescent conjugates that represent some of the major fluorophore classes (FIG. 12). These conjugates (Table 10) were all attached to a 186C variant that also contained the Q114A mutation which tunes the urea affinity to optimize responses in the clinical concentration range (see next section for construction of this mutant). Several conjugates exhibited large monochromatic intensity changes, most notably Alexa532 (~5-fold increase) and Oregon Green (~2-fold increase). IAEDANS exhibited a dichromatic response.

TABLE 10

Responses of fluorophores conjugated to the csUBP7 186C, Q114A[a].

| Fluorophore[b] | $\lambda^{ex}$ (nm)[c] | $^{apo}\lambda_{max}$ (nm) | $^{apo}I_{max}$ (AU x1000) | $^{sat}\lambda_{max}$ (nm) | $^{sat}I_{max}$ (AU x1000) | $^{true}K_d$ (mM) |
|---|---|---|---|---|---|---|
| Acrylodan | 391 | 496 | 27 | 515 | 17 | 0.7 |
| Badan | 391 | 527 | 20 | 527 | 20 | n/b |
| 5-IAF | 491 | 523 | 22.2 | 523 | 16.2 | 0.2 |
| DCIA | 384 | 463 | 66 | 463 | 66 | n/b |
| Oregon green | 496 | 522 | 18.5 | 522 | 40 | 0.3 |
| CPM | 384 | 469 | 61.5 | 478 | 59.8 | 2.5 |
| IANBD | 478 | 547 | 25.7 | 547 | 20.9 | 2.8 |
| IAEDANS | 336 | 479 | 11.6 | 487 | 5.6 | 2.3 |
| Pacific Blue | 410 | 455 | 37 | 455 | 37 | n/b |
| BODIPY 499 | 499 | 511 | 80 | 511 | 90 | 0.5 |
| BODIPY 507 | 507 | 543 | 4 | 547 | 4 | n/b |
| BODIPY 577 | 495 | 627 | 50 | 627 | 60 | 3.3 |
| Alexa 532 | 532 | 555 | 9.0 | 555 | 34.2 | 9.5 |
| Alexa 546 | 546 | 575 | 38.9 | 575 | 56.9 | 4.1 |
| Alexa 555 | 555 | 567 | 26.9 | 567 | 25.4 | 1.1 |
| Texas Red | 595 | 617 | 61 | 617 | 61 | n/b |
| Cy5 | 646 | 671 | 19 | 671 | 19 | n/b |
| PyMPO | 415 | 560 | 1.9 | 560 | 4.2 | 1.2 |

[a]$\lambda_{ex}$, preferred excitation wavelength (from supplier); $^{apo}\lambda_{max}$, observed maximum emission wavelength of the apo-protein; $^{apo}I_{max}$, observed intensity at $^{apo}\lambda_{max}$; $^{sat}\lambda_{max}$, observed maximum emission wavelength of the urea complex; $^{sat}I_{max}$, observed intensity at $^{sat}\lambda_{max}$; $^{true}K_d$, affinity determined from fit of equation 1 to the monochromatic emission intensities. Emission spectra were measured on the Nanodrop3300, using ~10 μM protein. The observed absolute emission intensities are a rough guide to the relative brightness of the conjugate, because the protein concentration was approximately the same for each experiment. See Table 6 for description of fits. Used linear baselines for saturated protein.
[b]Abbreviations, chemical names and supplier catalogue numbers as follows: Acrylodan (A433); Badan (B6057); 5-IAF (130451); Oregon Green 488 (O6034); CPM (D346); IANBD (D2004); IAEDANS (I14); Pacific Blue (P30506); BODIPY 499 (D20350); BODIPY 507 (D6004); BODIPY 577 (D20351); Alexa 532 (A10255); Alexa 555 (A20346); Texas Red (T6008); PyMPO (M6026) from Life Technologies and Cy5 (13080) from Lumiprobe.
[c]The Nanodrop3300 fixed wavelength LED that most closely matched $\lambda_{ex}$ was used.

Finally, we tested whether ngmFRET effects in doubly labeled proteins could improve ratiometric signaling. To this end, we fused a small, disulfide-containing domain, βZif (Smith et al., 2005, *Protein Sci*, 14, 64-73) to the C-terminus of several csUBP7 cysteine mutants (Table 11). This arrangement enables independent, site-specific labeling with two different, thiol-reactive fluorophores by first reacting at the unprotected thiol in the csUBP7, followed by a reduction of the βZif disulfide to deprotect and label this second site with a second fluorophore. The first fluorophore, attached to csUBP responds directly to urea binding (directly responsive partner), whereas the second one, attached to the βZif fusion, does not (indirectly responsive partner). Indirectly responsive partners are selected according to their excitation and emission characteristics such that ngmFRET is established with the directly responsive partner. Under favorable circumstances, monochromatic responses of the directly responsive partner or weak dichromatic responses can be converted in to strong ratiometric signals, by exploiting ligand-induced modulation of non-geometrical factors affecting ngmFRET such as changes in spectral overlap between the two partnered fluorophores, and alteration of non-radiative decay rates in the directly responsive partner. The mechanism for ngmFRET effects is detailed in Materials and Methods and PCT International Patent Application No. PCT/US16/62958, filed Nov. 19, 2016, the entire content of which is incorporated herein by reference.

TABLE 11

Urea affinities of csUBP7 βZif conjugates based on ngmFRET.

| Conjugate[a] | | Directly responsive partner | Response pattern[b] | | FRET coupling[c] | Emission (nm) | | Affinity[d] (mM) | |
|---|---|---|---|---|---|---|---|---|---|
| Mutant csUBP7 | βZif | | Donor | Acceptor | | $\lambda_1$ | $\lambda_2$ | $^{app}K_d$ | $^{true}K_d$ |
| 26C Acrylodan | Alexa532 | Donor | − | + | m | 490 | 550 | 0.15 | 0.17 |
| Badan | Alexa532 | Donor | + | − | m | 485 | 555 | 2.1 | 3.0 |
| 27C Acrylodan | Alexa532 | Donor | + | + | w | 510 | 550 | 9.1 | 13.0 |
| Badan | Alexa532 | Donor | − | 0 | s[e] | 555 | 500 | 0.2 | 0.2 |
| 30C Acrylodan | Alexa532 | Donor | − | − | m[f] | 490 | 550 | 0.01 | 0.006 |
| Badan | Alexa532 | Donor | + | − | m | 490 | 550 | 0.7 | 0.7 |
| 95C Acrylodan | Alexa532 | Donor | + | 0 | s | 480 | 550 | 0.7 | 0.7 |
| Badan | Alexa532 | Donor | 0 | 0 | s[e] | 490 | 550 | 1.1 | 1.1 |
| Badan | TexasRed | Donor | + | − | m | 483 | 613 | 2.6 | 2.1 |

TABLE 11-continued

Urea affinities of csUBP7 βZif conjugates based on ngmFRET.

| Conjugate[a] | | Directly responsive partner | Response pattern[b] | | FRET coupling[c] | Emission (nm) | | Affinity[d] (mM) | |
|---|---|---|---|---|---|---|---|---|---|
| Mutant csUBP7 | βZif | | Donor | Acceptor | | $\lambda_1$ | $\lambda_2$ | $^{app}K_d$ | $^{true}K_d$ |
| 186C OG | PB | Acceptor | − | + | m | 525 | 455 | 0.9 | 0.84 |
| Q114A Alexa532 | Badan | Acceptor | −[g] | + | s | 560 | 485 | 12.7 | 13.3 |
| Alexa532 | Acrylodan | Acceptor | − | + | m | 490 | 555 | 2 | 3.4 |

[a]csUBP7 and βZif indicate attachment site for the fluorophores. OG, Oregon Green; PB, Pacific Blue.
[b]Intensity changes of donor and acceptor with increasing urea concentration: 0, no change; +, increase; −, decrease.
[c]Qualitative assessment of energy transfer coupling factor, ϕ, based on relative intensities of the donor ($I_D$) and acceptor ($I_A$) emission intensities: w, weak ($I_D \gg I_A$); m, medium ($I_D \approx I_A$); strong ($I_D \ll I_A$). Medium coupling gives the best dichromatic responses.
[d]See Materials and methods for fitting procedures.
[e]Weak or no response due to extensive overlap of donor and acceptor emissions.
[f]Noisy data.
[g]Small change (if any).

Several dichromatic and monochromatic csUBP7 Acrylodan and Badan conjugates were combined as ngmFRET directly responsive donors with βZif Alexa532 indirectly responsive acceptors (Table 11). In several cases, the resulting ratiometric responses improved significantly. For instance, neither directly responsive fluorophore exhibits strong dichromatic responses when coupled by themselves at positions 26C, but in conjunction with the indirectly responsive Alexa532 conjugate, good ratiometric responses are observed. Both donor and acceptor fluorophores undergo opposing changes in emission intensities, consistent with a mechanism that is dominated by a change in spectral overlap between the two partners. This behavior is consistent with the ligand-mediated redistribution between the two green and blue excited state transition dipoles of the two singly labeled conjugates at this position (Table 8): Acrylodan undergoes a bathochromic shift, whereas Badan exhibits slight hypsochromicity. Accordingly, the spectral overlap between the directly responsive and indirectly responsive ngmFRET partners in the Acrylodan conjugate increases, resulting in enhancement of the energy transfer coupling factor, ϕ, and a corresponding loss in donor and gain in acceptor emission intensities (Table 12, $d^0\phi^+$). In the Badan conjugate, the opposite response pattern is observed, because the hypsochromic shift diminishes spectral overlap (Table 12, $d^0\phi^-$).

TABLE 12

Qualitative analysis of the patterns of donor and acceptor emission intensity changes in ngmFRET[a]

| Directly responsive partner | Model | $Q_A/Q_D$ | $Q_D$ | $Q_A$ |
|---|---|---|---|---|
| Donor | $d^0\phi^+$ | ↑ | ↓ | ↑ |
| | $d^0\phi^-$ | ↓ | ↑ | ↓ |
| | $d^+\phi^0$ | ↓ | ↓ | ↓ |
| | $d^+\phi^+$ | * | ↓ | * |
| | $d^+\phi^-$ | ↓ | * | ↓ |
| | $d^-\phi^0$ | ↑ | ↑ | ↑ |
| | $d^-\phi^+$ | ↑ | * | ↑ |
| | $d^-\phi^-$ | * | ↑ | * |
| Acceptor | $a^0\phi^+$ | ↑ | ↓ | * |
| | $a^0\phi^-$ | ↓ | ↑ | * |
| | $a^+\phi^0$ | ↓ | 0 | ↓ |
| | $a^+\phi^+$ | * | ↓ | * |
| | $a^+\phi^-$ | ↓ | ↑ | * |
| | $a^-\phi^0$ | ↑ | 0 | ↑ |
| | $a^-\phi^+$ | ↑ | ↓ | ↑ |
| | $a^-\phi^-$ | * | ↑ | * |

[a]The effects of increasing or decreasing quenching in the directly responsive ngmFRET partner (d for donors, a for acceptors) or the energy transfer coupling (ϕ) between the donor and acceptor are tabulated. The consequences of using a directly responsive donor or acceptor are examined. Changes in quenching and energy transfer coupling parameters can occur singly or in combination, leading to 16 possible models. The models examine the effects of the direction of change in quenching parameters (no change, $d^0$ or $a^0$; increase $d^+$ or $a^+$; decrease, $d^-$ or $a^-$) and the energy transfer coupling factor (no change, $\phi^0$; increase, $\phi^+$; decrease, $\phi^-$) on the patterns in the direction of change of the donor, $Q_D$ (equation 16) or acceptor, $Q_A$ (equation 18) quantum yields, and their ratio, $Q_A/Q_D$ (equation 19): ↑, increase; ↓, decrease; 0, no change; *, response is dependent on precise quantitation rather than direction of change in the underlying parameter values.

The monochromatic response of the directly responsive acceptor Alexa532 conjugate at 186C in csUBP7 (Table 10) was converted into a dichromatic signal by partnering with a indirectly responsive donor Acrylodan placed in the βZif fusion domain (FIG. 13). Both indirectly responsive donor and directly responsive acceptor intensities changed in response to urea, in opposite directions. This pattern can occur only if the energy transfer coupling factor, ϕ, changes between the partners as a consequence of a change in spectral overlap. Furthermore, the loss in donor and gain in acceptor intensities indicate a bathochromic shift of the directly responsive acceptor absorbance spectrum in response to ligand binding (Table 12, $a^0\phi^+$). Given that the response of the singly labeled directly responsive Alexa532 conjugate is monochromatic (Table 10), this conclusion indicates that Alexa532 undergoes a urea-mediated switch between two electronic transitions, only one of which is fluorescent, but both of which can be excited by resonance energy transfer.

The average energy transfer coupling strength plays in important role in determining the effectiveness for ratiometric of a particular ngmFRET fluorophore pair (Table 12). Coupling strengths can be scored qualitatively based on the relative sizes of the donor ($I_D$) and acceptor ($I_A$) emission intensities (also taking into account the differences in the quantum yield of the two partners). If the donor intensity exceeds that of the acceptor on average, than coupling is weak (e.g. csUBP7 27C·Acrylodan-βZif·Alexa523, Table 11). Conversely if $I_A$ consistently exceeds $I_D$, coupling is strong, because most of the donor excited state resonance is transferred to the acceptor (e.g. csUBP7 186C·Alexa532-βZif·Badan). Medium-strength coupling occurs when both intensities are on par. Extremes in coupling strength do not lead to usable ratiometric responses, because the intensities of one of the two partners remain low, thereby increasing the overall error in the signal. For the same directly responsive partner, coupling strengths are highly dependent on the indirectly responsive partner. For instance, the directly responsive 186C Alexa532 acceptor partnered with a indirectly responsive Acrylodan donor exhibits medium coupling strength, whereas partnered with a indirectly responsive Badan donor such strong coupling is established that the Badan emission intensity is barely observable. It is remarkable that a small change in the geometry of the linker group that mediates attachment of the same naphthalene fluorescent core (FIGS. 12A, B) results in such large differences. The Badan linker is one methylene group shorter than that of the Acrylodan, possibly causing differences in the conformational degrees of freedom of these two conjugates, which in turn could lead to differences in the average orientations between the ngmFRET partners and hence in resonance transfer efficiencies (κ effects, see Materials and Methods).

Example 6

Sensor Engineering Phase 5: Affinity Tuning

Normal blood urea concentrations range from about 1.8 mM to about 7.1 mM (Burtis, 2012, *Tietz Textbook of Clinical Chemistry and Molecular Diagnostics*. Elsevier). Measurements using reagentless sensors are most sensitive at analyte concentrations that match the dissociation constant (de Lorimier et al., 2002, *Protein Sci*, 11, 2655-75; Marvin et al., 1997, *Proc Natl Acad Sci USA*, 94, 4366-71). The urea affinity of csUBP7 186C·Acrylodan is too high and must therefore be "tuned" by raising the $K_d$ value.

The mutations that alter urea affinities fall into four classes:

1. Alteration of direct interactions in the PCS between the protein and the bound urea.
2. Manipulation of the equilibrium between the open (ligand-free) and closed (ligand-bound) states (Marvin and Hellinga, 2001, *Nat Struct Biol*, 8, 795-8).
3. Indirect interactions that alter the geometry of the binding site.
4. Alteration of interactions between the protein and the fluorescent conjugate.

The effects of mutations representing the first three classes of mutations were determined in the csUBP7 186C·Acrylodan conjugate. First, an alanine scan of the eight residues in the PCS was conducted to evaluate the relative contributions of these direct interactions (Table 13). This analysis revealed that the hydrogen bond formed by S92 to the amino common to both urea and acetamide (amine A) is critical. The loss of the second, more distant interaction by Y111 does affect binding strongly. The contributions of the three residues that interact with the amine not present in acetamide (amine B) differ by an order of magnitude. Most important is N211, the loss of which causes a large loss in affinity, whereas loss of either of the other two residues has much smaller effect. Both the carbonyl hydrogen bond by Y157 and the extensive van der Waals contact by F159 are important, as expected. Loss of the van der Waals interaction in V113A diminishes affinity as much as F159A, indicating that V113 functions as the second van der Waals surface that "sandwiches" the bound urea, analogous to the geometries observed in many other PBPs that bind a wide variety of organic ligands.

TABLE 13

Alanine scan of the PCS residues of csUBP7 186C labeled with Acrylodan[a].

| Comment | Mutant ID | Mutations | Emission (nm) $\lambda_1$ | $\lambda_2$ | Affinity[a,b] (mM) $^{app}K_d$ | $^{true}K_d$ |
|---|---|---|---|---|---|---|
| csUBP7 186C | | | 496 | 515 | 0.4 | 0.6 |
| Hydrogen bond to amine A | 11 | S92A | | | nb[c] | |
| Hydrogen bond to amine A | 12 | Y111A | 488 | 510 | 0.69[c] | 0.43[c] |
| Hydrogen bond to carbonyl | 13 | Y157A | 499 | 511 | 4.4 | 5.1 |
| Ring form extensive van der Waals contact | 14 | F159A | 488 | 510 | 13[c] | 9.1[c] |
| van der Waals contact | 15 | V113A | 488 | 510 | 18[c] | 15[c] |
| Hydrogen bond to amine B | 20 | Q114A | 495 | 555 | 1.1 | 0.9 |
| Hydrogen bond to amine B | 28 | N211A | 488 | 510 | 55[c] | 38[c] |
| Hydrogen bond to amine B | 36 | S238A | 495 | 550 | 3.9 | 3.1 |

[a]Determined by fitting the ratiometric signal of the intensities measured at λ1 and λ2 to equation 1-6.
[b]nb, no binding.
[c]Measured in a Roche LightCycler (see Materials and methods).

Exploration of class 1 effects was limited to the three-residue cluster forming interactions with amine group B and to the van der Waals interactions of V113. (Table 14). Even though the N211A mutant nearly abolishes binding, more subtle effects can be achieved by charge (N211D), geometry (N211Q, N211S, N211T), or a combination of both (N211E). Interestingly, the introduction of charge in N211E weakens affinity, whereas Q114E improves binding by an order of magnitude. The consequences of manipulating the van der Waals interactions of V113 are complex. Loss of this interaction in V113A weakens binding significantly. The introduction of a polar group in V113T has only a small effect. Bulkier polar groups weaken binding, but V113Q has a 10-fold stronger affinity than either V113N or V113H, suggesting that the glutamine forms an unanticipated hydrogen bond.

TABLE 14

Affinity-tuning mutations of csUBP7 186C-Acrylodan conjugates.

| Comment | Mutant ID | Mutations | Emission (nm) $\lambda_1$ | Emission (nm) $\lambda_2$ | Affinity[a,b] (mM) $^{true}K_d$ | Affinity[a,b] (mM) $^{app}K_d$ |
|---|---|---|---|---|---|---|
| csUBP7 186C | | | 496 | 515 | 0.4 | 0.6 |
| Class 1: hydrogen bond acceptor to amine | 9 | Q114S | 496 | 515 | 0.5 | 0.7 |
| | 10 | Q114N | 495 | 555 | 3.5 | 3.5 |
| | 20 | Q114A | 496 | 515 | 1.2 | 1.7 |
| | 21 | Q114D | 493 | | 15 | |
| | 22 | Q114E | 492 | 515 | 0.06 | 0.06 |
| | 23 | Q114H | 490 | | n/b | |
| | 24 | Q114T | 500 | | n/b | |
| | 25 | Q114Y | 492 | 505 | 7.1 | 5.8 |
| | 26 | Q114M | 491 | 505 | 20 | 15 |
| | 27 | Q114L | 491 | | n/b | |
| Class 1: hydrogen bond acceptor to amine | 28 | N211A | 488 | 510 | 55[c] | 38[c] |
| | 29 | N211Q | 492 | 510 | 0.8 | 1.0 |
| | 8, 30 | N211S | 492 | 510 | 14 | 13 |
| | 31 | N211D | 483 | 515 | 8.9 | 8.6 |
| | 32 | N211E | 492 | 505 | 6.2 | 5.9 |
| | 33 | N211H | 492 | | n/b | |
| | 34 | N211T | 497 | | 12 | |
| | 35 | N211L | 510 | 580 | 65[c] | 67[c] |
| Class 1: hydrogen bond acceptor to amine | 36 | S238A | 495 | 550 | 3.9 | 3.1 |
| | 37 | S238N | 492 | 505 | 18 | 15 |
| | 38 | S238Q | 491 | 505 | 3.6 | 3.6 |
| | 39 | S238H | 488 | 510 | 46[c] | 45[c] |
| Class 1: van der Waals contact | 15 | V113A | 488 | 510 | 18[c] | 15[c] |
| | 16 | V113T | 493 | 512 | 0.9 | 1.0 |
| | 17 | V113N | 493 | | 14 | |
| | 18 | V113Q | 491 | 507 | 1.2 | 1.3 |
| | 19 | V113H | 491 | 510 | 10 | 10 |
| Class 2: Removal of an inter-domain hydrogen bond | 2 | D288S | 488 | 510 | 0.37[c] | 0.25[c] |
| Class 2: Removal of a potential inter-domain water contact | 3 | E329G | 488 | 510 | 0.20[c] | 0.12[c] |
| Class 2: Removal of potential inter-domain hydrogen bonds | 1 | E43Q, K276N, K280M | 488 | 510 | 0.74[c] | 0.37[c] |
| Class 2: Removal of potential buried inter-domain hydrogen bond | 7 | S30I, E241A | 488 | 510 | 34[c] | 36[c] |
| Class 3: Secondary shell, forms hydrogen bond with S92 | 4 | E116Q | 488 | 510 | 180[c] | 170[c] |
| | 5 | E116D | 488 | 510 | 22[c] | 14[c] |
| | 6 | E116A | 488 | 510 | 18[c] | 11[c] |

[a]Determined by fitting the ratiometric signal of the intensities measured at $\lambda 1$ and $\lambda 2$ to equation 1-6.
[b]n/b, no binding.
[c]Measured in a Roche LightCycler (see Materials and methods).

Class 2 effects were explored by removing hydrogen bonds between the N- and C-terminal domains (Table 14), identified in the csUBP7 structure. The most effective of these was a double mutant (S30I, E241A) that removes two such inter-domain interactions, confirming that manipulation of conformational equilibria is an effective strategy for manipulating ligand affinities (Marvin and Hellinga, 2001, Nat Struct Biol, 8, 795-8).

Class 3 interactions were tested by removing secondary shell interactions. The glutamate at position 116 stabilizes the conformation of S92, the residue that binds the second urea amino group. Each of these has a large effect on urea affinity (Table 14), consistent with the observation that S92A abolishes binding (Table 13).

This collection of affinity-tuned fluorescently responsive sensors spans almost four orders of magnitude (from 60 µM to 180 mM) and contains candidates suitable both for clinical [e.g. (less than about 2 mM), within (about 2 mM to about 7 mM), or above (greater than about 7 mM) the normal range of human blood] and environmental sensing (e.g., from 60 µM to 180 mM).

Example 7

Sensor Arrays for Detecting a Wide Range of Urea Concentrations

The precision (reciprocal of the error) of individual sensor precision is maximal at the $K_d$ value, and decreases at lower or higher urea concentrations (Marvin et al., 1997, Proc Natl Acad Sci USA, 94, 4366-71). Construction of a high-precision sensor capable of spanning the entire clinical concentration range from 1.8 to 7.1 mM would benefit from combining several sensors together to maintain a high precision level. Candidates for such a high-precision sensor array include csUBP7 186C·Acrylodan and the Q114A, Q114Y mutants in this background.

Example 8

Sensor Engineering Phase 6: Device Integration

Figure 14:
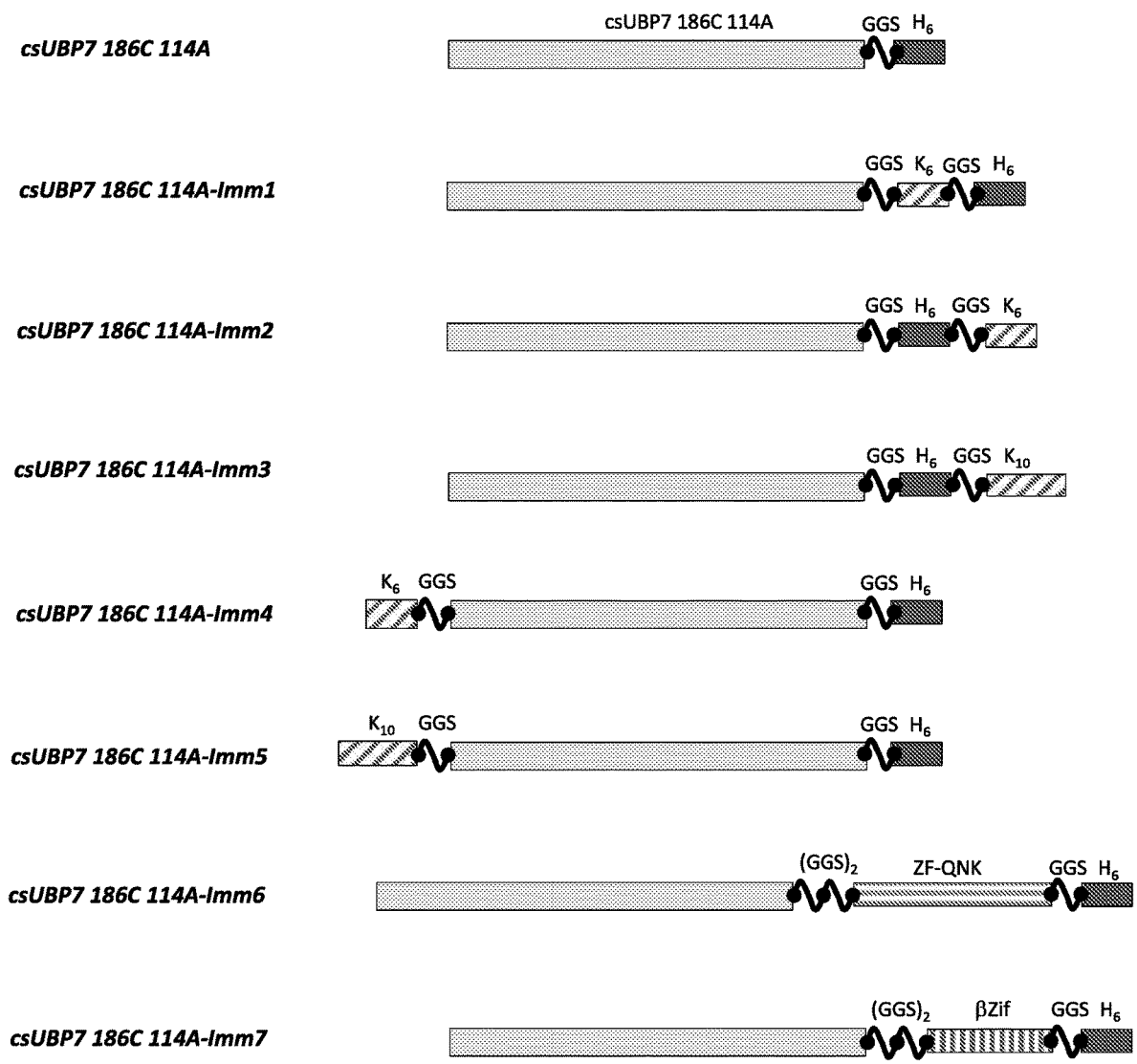
FIG. 14 is a set of cartoons depicting fusion constructs for sensor immobilization. Light gray, csUBP7 186C 114A; diagonal striped, hexa-lysine immobilization tag; dark gray, hexa-histidine affinity purification tag; horizontal striped, ZF-QNK zinc finger domain; vertical striped, truncated zinc finger βZif domain; wavy line, Gly-Gly-Ser linker (two segments, indicate Gly-Gly-Ser-Gly-Gly-Ser). Left column, names of constructs.

Protein immobilization on solid surfaces is an important step for incorporating biosensors into devices. Immobilization enables (i) spatial localization, (ii) control over the presentation of the sensors to the reader (e.g. by encoding geometries for optical readouts), (iii) selective retention in sample separation procedures. It is advantageous to control the geometry of the protein attachment to the solid surface, in order to minimize perturbation of the fluorescence sensing mechanism. Such constructs fuse an N- or C-terminal protein domain that can mediate site-specific attachment to an appropriately chemically activated surface. For instance, hexa-histidine peptide for metal-mediated immobilization, a hexa-lysine peptide for attachment to amine-reactive groups, or a zinc-finger domain (ZF-QNK) (Smith et al., 2005, *Protein Sci,* 14, 64-73), or a disulfide-containing truncated zinc finger (βZif)(Smith et al., 2005, *Protein Sci,* 14, 64-73) at N- or C-termini of the FRS to thiol-reactive groups (FIG. 14). Here we show that site-specific attachment of a robust urea sensor to suitably derivatized agarose beads conserves its emission fluorescence spectral response, binding affinity, and thermostability.

Figure 15A:
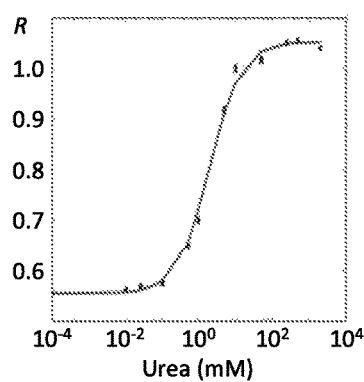
FIGS. 15A-D are graphs showing that the immobilization of csUBP7 95C·Badan does not affect its thermostability or its binding affinity to urea.
Figure 15B:
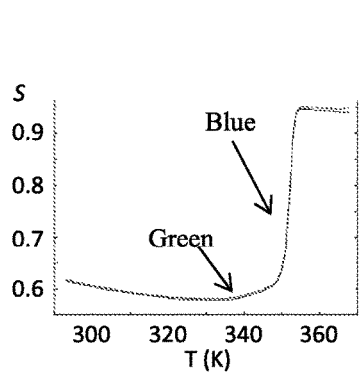
Figure 15C:
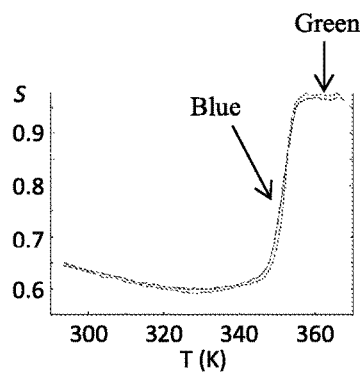

The csUBP7 186C·Acrylodan Q114A protein was site-specifically immobilized on agarose beads derivatized with N-hydroxysuccinimide through a carboxy-terminal hexa-lysine fusion tag. This protein also was site-specifically immobilized through its C-terminal hexa-histidine tag on commercially available agarose-coated magnetic beads derivatized with Ni-NTA. The use of magnetic beads affords a straightforward means for holding the beads in place within their respective sensor patches in the sampling cartridge with a magnetic field. The immobilized proteins exhibited a urea titration curve similar to that measured in solution (FIG. 15A), indicating that immobilization interferes neither with ligand binding nor with the fluorescent signaling mechanism. Furthermore, comparison of protein thermostabilities determined in solution and on beads showed that protein stabilities are not perturbed significantly by immobilization FIG. 15B, C).

Figure 15D:
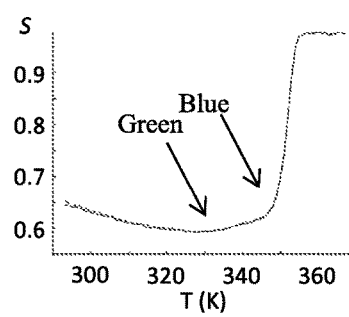

The urea-responsive magnetic beads were dried by incubation at 50° C. for 20 minutes, using an aqueous ammonium bicarbonate buffer. The stability properties of the sensor are approximately retained up on rehydration (FIG. 15D). The csUBP7-based FRSs therefore are sufficiently robust to be handled at ambient temperatures in a desiccated state, greatly simplifying manufacturing, distribution, and long-term storage conditions.

Example 9

Crystal Structure Coordinates for csUBP7 Urea-Binding Protein (Mature Form)

Atom positions are provided as Cartesian coordinates, using standard Protein Databank (PDB) format. ATOM records refer to amino acids (naming is standard three-letter amino acid code); HETATM records refer to non-amino acid atoms.

Column 1: record type (ATOM or HEATM); column 2: atom number; column 3 atom name (standard naming scheme for amino acids); column 4: residue name (ATOM records), or component name (HETATM records); column 5: chain identifier (A, B, C, . . . ); column 6: amino acid residue sequence number (ATOM records), or component number (HETATM records); columns 7-9: x,y,z Cartesian positional coordinates; column 10: fractional occupancy (set to 10.0 in listing); column 11: B-factor (ignored in this listing); column 12: file identifier (ignored in this listing); column 13: line number (same as atom number in this listing).

For heteratom (HETATM) records, the component name (column 4) is as follows:
HOH, water
URE, urea
Provided are coordinates for the two protein molecules (chain identifiers A and B) in the asymmetric unit, their bound urea ligand (chain identifiers C and D), and the ordered solvent waters (chain identifier S).

| ATOM | 9  | N   | ILE A | 15 | 7.009  | 63.200 | 28.310 | 1.00 | 0.00 XXXX | 9  |
|------|----|-----|-------|----|--------|--------|--------|------|-----------|----|
| ATOM | 10 | CA  | ILE A | 15 | 5.562  | 63.372 | 28.226 | 1.00 | 0.00 XXXX | 10 |
| ATOM | 11 | C   | ILE A | 15 | 4.922  | 62.811 | 29.487 | 1.00 | 0.00 XXXX | 11 |
| ATOM | 12 | O   | ILE A | 15 | 4.916  | 61.599 | 29.697 | 1.00 | 0.00 XXXX | 12 |
| ATOM | 13 | CB  | ILE A | 15 | 4.949  | 62.669 | 27.002 | 1.00 | 0.00 XXXX | 13 |
| ATOM | 14 | CG1 | ILE A | 15 | 5.395  | 63.347 | 25.708 | 1.00 | 0.00 XXXX | 14 |
| ATOM | 15 | CD1 | ILE A | 15 | 4.991  | 62.588 | 24.464 | 1.00 | 0.00 XXXX | 15 |
| ATOM | 16 | CG2 | ILE A | 15 | 3.432  | 62.692 | 27.088 | 1.00 | 0.00 XXXX | 16 |
| ATOM | 17 | N   | LYS A | 16 | 4.390  | 63.687 | 30.329 | 1.00 | 0.00 XXXX | 17 |
| ATOM | 18 | CA  | LYS A | 16 | 3.826  | 63.243 | 31.594 | 1.00 | 0.00 XXXX | 18 |
| ATOM | 19 | C   | LYS A | 16 | 2.417  | 62.696 | 31.411 | 1.00 | 0.00 XXXX | 19 |
| ATOM | 20 | O   | LYS A | 16 | 1.592  | 63.281 | 30.708 | 1.00 | 0.00 XXXX | 20 |
| ATOM | 21 | CB  | LYS A | 16 | 3.834  | 64.381 | 32.615 | 1.00 | 0.00 XXXX | 21 |
| ATOM | 22 | CG  | LYS A | 16 | 5.235  | 64.766 | 33.059 | 1.00 | 0.00 XXXX | 22 |
| ATOM | 23 | CD  | LYS A | 16 | 5.219  | 65.820 | 34.148 | 1.00 | 0.00 XXXX | 23 |
| ATOM | 24 | CE  | LYS A | 16 | 6.631  | 66.108 | 34.634 | 1.00 | 0.00 XXXX | 24 |
| ATOM | 25 | NZ  | LYS A | 16 | 6.649  | 67.081 | 35.759 | 1.00 | 0.00 XXXX | 25 |
| ATOM | 26 | N   | VAL A | 17 | 2.158  | 61.560 | 32.048 | 1.00 | 0.00 XXXX | 26 |
| ATOM | 27 | CA  | VAL A | 17 | 0.844  | 60.939 | 32.018 | 1.00 | 0.00 XXXX | 27 |
| ATOM | 28 | C   | VAL A | 17 | 0.393  | 60.653 | 33.442 | 1.00 | 0.00 XXXX | 28 |
| ATOM | 29 | O   | VAL A | 17 | 1.196  | 60.268 | 34.292 | 1.00 | 0.00 XXXX | 29 |
| ATOM | 30 | CB  | VAL A | 17 | 0.846  | 59.633 | 31.199 | 1.00 | 0.00 XXXX | 30 |
| ATOM | 31 | CG1 | VAL A | 17 | 1.297  | 59.901 | 29.769 | 1.00 | 0.00 XXXX | 31 |
| ATOM | 32 | CG2 | VAL A | 17 | 1.738  | 58.591 | 31.858 | 1.00 | 0.00 XXXX | 32 |
| ATOM | 33 | N   | GLY A | 18 | -0.893 | 60.844 | 33.701 | 1.00 | 0.00 XXXX | 33 |
| ATOM | 34 | CA  | GLY A | 18 | -1.421 | 60.650 | 35.036 | 1.00 | 0.00 XXXX | 34 |
| ATOM | 35 | C   | GLY A | 18 | -1.924 | 59.244 | 35.286 | 1.00 | 0.00 XXXX | 35 |
| ATOM | 36 | O   | GLY A | 18 | -2.511 | 58.613 | 34.407 | 1.00 | 0.00 XXXX | 36 |
| ATOM | 37 | N   | ILE A | 19 | -1.682 | 58.753 | 36.496 | 1.00 | 0.00 XXXX | 37 |
| ATOM | 38 | CA  | ILE A | 19 | -2.271 | 57.504 | 36.953 | 1.00 | 0.00 XXXX | 38 |
| ATOM | 39 | C   | ILE A | 19 | -3.056 | 57.785 | 38.225 | 1.00 | 0.00 XXXX | 39 |
| ATOM | 40 | O   | ILE A | 19 | -2.486 | 58.173 | 39.245 | 1.00 | 0.00 XXXX | 40 |
| ATOM | 41 | CB  | ILE A | 19 | -1.206 | 56.424 | 37.215 | 1.00 | 0.00 XXXX | 41 |
| ATOM | 42 | CG1 | ILE A | 19 | -0.555 | 55.989 | 35.900 | 1.00 | 0.00 XXXX | 42 |

-continued

| | | | | | | | | | | |
|---|---|---|---|---|---|---|---|---|---|---|
| ATOM | 43 | CD1 | ILE A | 19 | 0.550 | 54.968 | 36.077 | 1.00 | 0.00 | XXXX | 43 |
| ATOM | 44 | CG2 | ILE A | 19 | −1.824 | 55.229 | 37.923 | 1.00 | 0.00 | XXXX | 44 |
| ATOM | 45 | N | LEU A | 20 | −4.368 | 57.592 | 38.160 | 1.00 | 0.00 | XXXX | 45 |
| ATOM | 46 | CA | LEU A | 20 | −5.248 | 57.986 | 39.250 | 1.00 | 0.00 | XXXX | 46 |
| ATOM | 47 | C | LEU A | 20 | −6.163 | 56.836 | 39.659 | 1.00 | 0.00 | XXXX | 47 |
| ATOM | 48 | O | LEU A | 20 | −7.189 | 56.585 | 39.026 | 1.00 | 0.00 | XXXX | 48 |
| ATOM | 49 | CB | LEU A | 20 | −6.068 | 59.213 | 38.841 | 1.00 | 0.00 | XXXX | 49 |
| ATOM | 50 | CG | LEU A | 20 | −7.104 | 59.755 | 39.825 | 1.00 | 0.00 | XXXX | 50 |
| ATOM | 51 | CD1 | LEU A | 20 | −6.461 | 60.063 | 41.167 | 1.00 | 0.00 | XXXX | 51 |
| ATOM | 52 | CD2 | LEU A | 20 | −7.774 | 60.995 | 39.250 | 1.00 | 0.00 | XXXX | 52 |
| ATOM | 53 | N | HIS A | 21 | −5.779 | 56.143 | 40.726 | 1.00 | 0.00 | XXXX | 53 |
| ATOM | 54 | CA | HIS A | 21 | −6.503 | 54.969 | 41.195 | 1.00 | 0.00 | XXXX | 54 |
| ATOM | 55 | C | HIS A | 21 | −6.562 | 54.941 | 42.716 | 1.00 | 0.00 | XXXX | 55 |
| ATOM | 56 | O | HIS A | 21 | −5.779 | 55.612 | 43.389 | 1.00 | 0.00 | XXXX | 56 |
| ATOM | 57 | CB | HIS A | 21 | −5.846 | 53.685 | 40.679 | 1.00 | 0.00 | XXXX | 57 |
| ATOM | 58 | CG | HIS A | 21 | −6.150 | 53.380 | 39.246 | 1.00 | 0.00 | XXXX | 58 |
| ATOM | 59 | ND1 | HIS A | 21 | −7.417 | 53.060 | 38.808 | 1.00 | 0.00 | XXXX | 59 |
| ATOM | 60 | CD2 | HIS A | 21 | −5.353 | 53.342 | 38.152 | 1.00 | 0.00 | XXXX | 60 |
| ATOM | 61 | CE1 | HIS A | 21 | −7.388 | 52.839 | 37.506 | 1.00 | 0.00 | XXXX | 61 |
| ATOM | 62 | NE2 | HIS A | 21 | −6.147 | 53.005 | 37.083 | 1.00 | 0.00 | XXXX | 62 |
| ATOM | 63 | N | SER A | 22 | −7.498 | 54.167 | 43.254 | 1.00 | 0.00 | XXXX | 63 |
| ATOM | 64 | CA | SER A | 22 | −7.576 | 53.958 | 44.693 | 1.00 | 0.00 | XXXX | 64 |
| ATOM | 65 | C | SER A | 22 | −6.465 | 53.022 | 45.154 | 1.00 | 0.00 | XXXX | 65 |
| ATOM | 66 | O | SER A | 22 | −6.556 | 51.808 | 44.981 | 1.00 | 0.00 | XXXX | 66 |
| ATOM | 67 | CB | SER A | 22 | −8.944 | 53.395 | 45.083 | 1.00 | 0.00 | XXXX | 67 |
| ATOM | 68 | OG | SER A | 22 | −9.984 | 54.262 | 44.669 | 1.00 | 0.00 | XXXX | 68 |
| ATOM | 69 | N | LEU A | 23 | −5.419 | 53.593 | 45.742 | 1.00 | 0.00 | XXXX | 69 |
| ATOM | 70 | CA | LEU A | 23 | −4.316 | 52.805 | 46.279 | 1.00 | 0.00 | XXXX | 70 |
| ATOM | 71 | C | LEU A | 23 | −4.530 | 52.559 | 47.765 | 1.00 | 0.00 | XXXX | 71 |
| ATOM | 72 | O | LEU A | 23 | −3.786 | 51.811 | 48.399 | 1.00 | 0.00 | XXXX | 72 |
| ATOM | 73 | CB | LEU A | 23 | −2.985 | 53.515 | 46.039 | 1.00 | 0.00 | XXXX | 73 |
| ATOM | 74 | CG | LEU A | 23 | −2.789 | 54.016 | 44.606 | 1.00 | 0.00 | XXXX | 74 |
| ATOM | 75 | CD1 | LEU A | 23 | −1.432 | 54.684 | 44.441 | 1.00 | 0.00 | XXXX | 75 |
| ATOM | 76 | CD2 | LEU A | 23 | −2.966 | 52.881 | 43.606 | 1.00 | 0.00 | XXXX | 76 |
| ATOM | 77 | N | SER A | 24 | −5.558 | 53.204 | 48.305 | 1.00 | 0.00 | XXXX | 77 |
| ATOM | 78 | CA | SER A | 24 | −5.993 | 52.986 | 49.678 | 1.00 | 0.00 | XXXX | 78 |
| ATOM | 79 | C | SER A | 24 | −7.516 | 52.978 | 49.725 | 1.00 | 0.00 | XXXX | 79 |
| ATOM | 80 | O | SER A | 24 | −8.173 | 53.438 | 48.791 | 1.00 | 0.00 | XXXX | 80 |
| ATOM | 81 | CB | SER A | 24 | −5.432 | 54.062 | 50.612 | 1.00 | 0.00 | XXXX | 81 |
| ATOM | 82 | OG | SER A | 24 | −5.916 | 55.350 | 50.268 | 1.00 | 0.00 | XXXX | 82 |
| ATOM | 83 | N | GLY A | 25 | −8.075 | 52.453 | 50.808 | 1.00 | 0.00 | XXXX | 83 |
| ATOM | 84 | CA | GLY A | 25 | −9.516 | 52.415 | 50.965 | 1.00 | 0.00 | XXXX | 84 |
| ATOM | 85 | C | GLY A | 25 | −10.153 | 51.160 | 50.401 | 1.00 | 0.00 | XXXX | 85 |
| ATOM | 86 | O | GLY A | 25 | −9.465 | 50.255 | 49.928 | 1.00 | 0.00 | XXXX | 86 |
| ATOM | 87 | N | THR A | 26 | −11.480 | 51.119 | 50.452 | 1.00 | 0.00 | XXXX | 87 |
| ATOM | 88 | CA | THR A | 26 | −12.249 | 49.925 | 50.115 | 1.00 | 0.00 | XXXX | 88 |
| ATOM | 89 | C | THR A | 26 | −12.073 | 49.442 | 48.674 | 1.00 | 0.00 | XXXX | 89 |
| ATOM | 90 | O | THR A | 26 | −12.328 | 48.275 | 48.378 | 1.00 | 0.00 | XXXX | 90 |
| ATOM | 91 | CB | THR A | 26 | −13.755 | 50.156 | 50.366 | 1.00 | 0.00 | XXXX | 91 |
| ATOM | 92 | OG1 | THR A | 26 | −14.468 | 48.924 | 50.198 | 1.00 | 0.00 | XXXX | 92 |
| ATOM | 93 | CG2 | THR A | 26 | −14.310 | 51.199 | 49.402 | 1.00 | 0.00 | XXXX | 93 |
| ATOM | 94 | N | MET A | 27 | −11.649 | 50.329 | 47.777 | 1.00 | 0.00 | XXXX | 94 |
| ATOM | 95 | CA | MET A | 27 | −11.507 | 49.963 | 46.367 | 1.00 | 0.00 | XXXX | 95 |
| ATOM | 96 | C | MET A | 27 | −10.088 | 49.523 | 45.995 | 1.00 | 0.00 | XXXX | 96 |
| ATOM | 97 | O | MET A | 27 | −9.841 | 49.102 | 44.863 | 1.00 | 0.00 | XXXX | 97 |
| ATOM | 98 | CB | MET A | 27 | −11.933 | 51.129 | 45.469 | 1.00 | 0.00 | XXXX | 98 |
| ATOM | 99 | CG | MET A | 27 | −13.423 | 51.448 | 45.510 | 1.00 | 0.00 | XXXX | 99 |
| ATOM | 100 | SD | MET A | 27 | −14.467 | 50.021 | 45.148 | 1.00 | 0.00 | XXXX | 100 |
| ATOM | 101 | CE | MET A | 27 | −13.779 | 49.472 | 43.589 | 1.00 | 0.00 | XXXX | 101 |
| ATOM | 102 | N | SER A | 28 | −9.161 | 49.615 | 46.944 | 1.00 | 0.00 | XXXX | 102 |
| ATOM | 103 | CA | SER A | 28 | −7.758 | 49.318 | 46.662 | 1.00 | 0.00 | XXXX | 103 |
| ATOM | 104 | C | SER A | 28 | −7.553 | 47.848 | 46.303 | 1.00 | 0.00 | XXXX | 104 |
| ATOM | 105 | O | SER A | 28 | −6.591 | 47.498 | 45.619 | 1.00 | 0.00 | XXXX | 105 |
| ATOM | 106 | CB | SER A | 28 | −6.874 | 49.698 | 47.855 | 1.00 | 0.00 | XXXX | 106 |
| ATOM | 107 | OG | SER A | 28 | −7.141 | 48.879 | 48.982 | 1.00 | 0.00 | XXXX | 107 |
| ATOM | 108 | N | ILE A | 29 | −8.456 | 46.993 | 46.772 | 1.00 | 0.00 | XXXX | 108 |
| ATOM | 109 | CA | ILE A | 29 | −8.422 | 45.576 | 46.429 | 1.00 | 0.00 | XXXX | 109 |
| ATOM | 110 | C | ILE A | 29 | −8.471 | 45.389 | 44.915 | 1.00 | 0.00 | XXXX | 110 |
| ATOM | 111 | O | ILE A | 29 | −7.891 | 44.447 | 44.370 | 1.00 | 0.00 | XXXX | 111 |
| ATOM | 112 | CB | ILE A | 29 | −9.592 | 44.809 | 47.080 | 1.00 | 0.00 | XXXX | 112 |
| ATOM | 113 | CG1 | ILE A | 29 | −9.506 | 43.316 | 46.757 | 1.00 | 0.00 | XXXX | 113 |
| ATOM | 114 | CG2 | ILE A | 29 | −10.931 | 45.391 | 46.637 | 1.00 | 0.00 | XXXX | 114 |
| ATOM | 115 | CD1 | ILE A | 29 | −10.560 | 42.479 | 47.455 | 1.00 | 0.00 | XXXX | 115 |
| ATOM | 116 | N | SER A | 30 | −9.171 | 46.300 | 44.248 | 1.00 | 0.00 | XXXX | 116 |
| ATOM | 117 | CA | SER A | 30 | −9.398 | 46.216 | 42.811 | 1.00 | 0.00 | XXXX | 117 |
| ATOM | 118 | C | SER A | 30 | −8.435 | 47.063 | 41.979 | 1.00 | 0.00 | XXXX | 118 |
| ATOM | 119 | O | SER A | 30 | −7.970 | 46.625 | 40.929 | 1.00 | 0.00 | XXXX | 119 |
| ATOM | 120 | CB | SER A | 30 | −10.838 | 46.625 | 42.487 | 1.00 | 0.00 | XXXX | 120 |
| ATOM | 121 | OG | SER A | 30 | −11.755 | 45.615 | 42.868 | 1.00 | 0.00 | XXXX | 121 |

-continued

| | | | | | | | | | | |
|---|---|---|---|---|---|---|---|---|---|---|
| ATOM | 122 | N | GLU A | 31 | −8.130 | 48.269 | 42.450 | 1.00 | 0.00 | XXXX | 122 |
| ATOM | 123 | CA | GLU A | 31 | −7.507 | 49.276 | 41.590 | 1.00 | 0.00 | XXXX | 123 |
| ATOM | 124 | C | GLU A | 31 | −5.979 | 49.292 | 41.589 | 1.00 | 0.00 | XXXX | 124 |
| ATOM | 125 | O | GLU A | 31 | −5.371 | 49.830 | 40.663 | 1.00 | 0.00 | XXXX | 125 |
| ATOM | 126 | CB | GLU A | 31 | −8.010 | 50.668 | 41.977 | 1.00 | 0.00 | XXXX | 126 |
| ATOM | 127 | CG | GLU A | 31 | −9.492 | 50.895 | 41.723 | 1.00 | 0.00 | XXXX | 127 |
| ATOM | 128 | CD | GLU A | 31 | −9.875 | 52.358 | 41.834 | 1.00 | 0.00 | XXXX | 128 |
| ATOM | 129 | OE1 | GLU A | 31 | −9.235 | 53.190 | 41.157 | 1.00 | 0.00 | XXXX | 129 |
| ATOM | 130 | OE2 | GLU A | 31 | −10.816 | 52.677 | 42.592 | 1.00 | 0.00 | XXXX | 130 |
| ATOM | 131 | N | VAL A | 32 | −5.356 | 48.733 | 42.622 | 1.00 | 0.00 | XXXX | 131 |
| ATOM | 132 | CA | VAL A | 32 | −3.898 | 48.748 | 42.701 | 1.00 | 0.00 | XXXX | 132 |
| ATOM | 133 | C | VAL A | 32 | −3.287 | 48.014 | 41.513 | 1.00 | 0.00 | XXXX | 133 |
| ATOM | 134 | O | VAL A | 32 | −2.295 | 48.463 | 40.940 | 1.00 | 0.00 | XXXX | 134 |
| ATOM | 135 | CB | VAL A | 32 | −3.384 | 48.117 | 44.006 | 1.00 | 0.00 | XXXX | 135 |
| ATOM | 136 | CG1 | VAL A | 32 | −1.884 | 47.846 | 43.907 | 1.00 | 0.00 | XXXX | 136 |
| ATOM | 137 | CG2 | VAL A | 32 | −3.694 | 49.025 | 45.187 | 1.00 | 0.00 | XXXX | 137 |
| ATOM | 138 | N | SER A | 33 | −3.897 | 46.894 | 41.138 | 1.00 | 0.00 | XXXX | 138 |
| ATOM | 139 | CA | SER A | 33 | −3.404 | 46.086 | 40.028 | 1.00 | 0.00 | XXXX | 139 |
| ATOM | 140 | C | SER A | 33 | −3.590 | 46.794 | 38.687 | 1.00 | 0.00 | XXXX | 140 |
| ATOM | 141 | O | SER A | 33 | −2.910 | 46.475 | 37.711 | 1.00 | 0.00 | XXXX | 141 |
| ATOM | 142 | CB | SER A | 33 | −4.104 | 44.725 | 40.003 | 1.00 | 0.00 | XXXX | 142 |
| ATOM | 143 | OG | SER A | 33 | −5.508 | 44.871 | 39.881 | 1.00 | 0.00 | XXXX | 143 |
| ATOM | 144 | N | LEU A | 34 | −4.508 | 47.754 | 38.639 | 1.00 | 0.00 | XXXX | 144 |
| ATOM | 145 | CA | LEU A | 34 | −4.677 | 48.567 | 37.440 | 1.00 | 0.00 | XXXX | 145 |
| ATOM | 146 | C | LEU A | 34 | −3.488 | 49.509 | 37.282 | 1.00 | 0.00 | XXXX | 146 |
| ATOM | 147 | O | LEU A | 34 | −3.016 | 49.743 | 36.169 | 1.00 | 0.00 | XXXX | 147 |
| ATOM | 148 | CB | LEU A | 34 | −5.987 | 49.358 | 37.486 | 1.00 | 0.00 | XXXX | 148 |
| ATOM | 149 | CG | LEU A | 34 | −7.274 | 48.532 | 37.524 | 1.00 | 0.00 | XXXX | 149 |
| ATOM | 150 | CD1 | LEU A | 34 | −8.487 | 49.405 | 37.221 | 1.00 | 0.00 | XXXX | 150 |
| ATOM | 151 | CD2 | LEU A | 34 | −7.193 | 47.364 | 36.556 | 1.00 | 0.00 | XXXX | 151 |
| ATOM | 152 | N | LYS A | 35 | −3.018 | 50.055 | 38.400 | 1.00 | 0.00 | XXXX | 152 |
| ATOM | 153 | CA | LYS A | 35 | −1.796 | 50.850 | 38.407 | 1.00 | 0.00 | XXXX | 153 |
| ATOM | 154 | C | LYS A | 35 | −0.622 | 50.026 | 37.885 | 1.00 | 0.00 | XXXX | 154 |
| ATOM | 155 | O | LYS A | 35 | 0.201 | 50.518 | 37.113 | 1.00 | 0.00 | XXXX | 155 |
| ATOM | 156 | CB | LYS A | 35 | −1.488 | 51.370 | 39.814 | 1.00 | 0.00 | XXXX | 156 |
| ATOM | 157 | CG | LYS A | 35 | −0.135 | 52.059 | 39.927 | 1.00 | 0.00 | XXXX | 157 |
| ATOM | 158 | CD | LYS A | 35 | 0.485 | 51.885 | 41.303 | 1.00 | 0.00 | XXXX | 158 |
| ATOM | 159 | CE | LYS A | 35 | 0.810 | 50.430 | 41.589 | 1.00 | 0.00 | XXXX | 159 |
| ATOM | 160 | NZ | LYS A | 35 | 1.679 | 50.289 | 42.792 | 1.00 | 0.00 | XXXX | 160 |
| ATOM | 161 | N | ASP A | 36 | −0.553 | 48.769 | 38.315 | 1.00 | 0.00 | XXXX | 161 |
| ATOM | 162 | CA | ASP A | 36 | 0.507 | 47.862 | 37.886 | 1.00 | 0.00 | XXXX | 162 |
| ATOM | 163 | C | ASP A | 36 | 0.450 | 47.618 | 36.382 | 1.00 | 0.00 | XXXX | 163 |
| ATOM | 164 | O | ASP A | 36 | 1.479 | 47.614 | 35.707 | 1.00 | 0.00 | XXXX | 164 |
| ATOM | 165 | CB | ASP A | 36 | 0.411 | 46.528 | 38.630 | 1.00 | 0.00 | XXXX | 165 |
| ATOM | 166 | CG | ASP A | 36 | 0.739 | 46.654 | 40.105 | 1.00 | 0.00 | XXXX | 166 |
| ATOM | 167 | OD1 | ASP A | 36 | 1.432 | 47.621 | 40.486 | 1.00 | 0.00 | XXXX | 167 |
| ATOM | 168 | OD2 | ASP A | 36 | 0.300 | 45.782 | 40.883 | 1.00 | 0.00 | XXXX | 168 |
| ATOM | 169 | N | ALA A | 37 | −0.758 | 47.411 | 35.866 | 1.00 | 0.00 | XXXX | 169 |
| ATOM | 170 | CA | ALA A | 37 | −0.956 | 47.171 | 34.440 | 1.00 | 0.00 | XXXX | 170 |
| ATOM | 171 | C | ALA A | 37 | −0.545 | 48.383 | 33.609 | 1.00 | 0.00 | XXXX | 171 |
| ATOM | 172 | O | ALA A | 37 | 0.132 | 48.250 | 32.589 | 1.00 | 0.00 | XXXX | 172 |
| ATOM | 173 | CB | ALA A | 37 | −2.409 | 46.808 | 34.160 | 1.00 | 0.00 | XXXX | 173 |
| ATOM | 174 | N | GLU A | 38 | −0.957 | 49.565 | 34.053 | 1.00 | 0.00 | XXXX | 174 |
| ATOM | 175 | CA | GLU A | 38 | −0.653 | 50.796 | 33.335 | 1.00 | 0.00 | XXXX | 175 |
| ATOM | 176 | C | GLU A | 38 | 0.845 | 51.091 | 33.347 | 1.00 | 0.00 | XXXX | 176 |
| ATOM | 177 | O | GLU A | 38 | 1.400 | 51.550 | 32.349 | 1.00 | 0.00 | XXXX | 177 |
| ATOM | 178 | CB | GLU A | 38 | −1.440 | 51.965 | 33.930 | 1.00 | 0.00 | XXXX | 178 |
| ATOM | 179 | CG | GLU A | 38 | −2.943 | 51.845 | 33.720 | 1.00 | 0.00 | XXXX | 179 |
| ATOM | 180 | CD | GLU A | 38 | −3.751 | 52.494 | 34.828 | 1.00 | 0.00 | XXXX | 180 |
| ATOM | 181 | OE1 | GLU A | 38 | −3.141 | 53.052 | 35.762 | 1.00 | 0.00 | XXXX | 181 |
| ATOM | 182 | OE2 | GLU A | 38 | −4.998 | 52.443 | 34.763 | 1.00 | 0.00 | XXXX | 182 |
| ATOM | 183 | N | LEU A | 39 | 1.497 | 50.827 | 34.475 | 1.00 | 0.00 | XXXX | 183 |
| ATOM | 184 | CA | LEU A | 39 | 2.933 | 51.057 | 34.584 | 1.00 | 0.00 | XXXX | 184 |
| ATOM | 185 | C | LEU A | 39 | 3.730 | 50.078 | 33.724 | 1.00 | 0.00 | XXXX | 185 |
| ATOM | 186 | O | LEU A | 39 | 4.786 | 50.429 | 33.197 | 1.00 | 0.00 | XXXX | 186 |
| ATOM | 187 | CB | LEU A | 39 | 3.389 | 50.970 | 36.043 | 1.00 | 0.00 | XXXX | 187 |
| ATOM | 188 | CG | LEU A | 39 | 3.026 | 52.174 | 36.914 | 1.00 | 0.00 | XXXX | 188 |
| ATOM | 189 | CD1 | LEU A | 39 | 3.392 | 51.929 | 38.369 | 1.00 | 0.00 | XXXX | 189 |
| ATOM | 190 | CD2 | LEU A | 39 | 3.715 | 53.425 | 36.390 | 1.00 | 0.00 | XXXX | 190 |
| ATOM | 191 | N | MET A | 40 | 3.234 | 48.851 | 33.587 | 1.00 | 0.00 | XXXX | 191 |
| ATOM | 192 | CA | MET A | 40 | 3.903 | 47.866 | 32.742 | 1.00 | 0.00 | XXXX | 192 |
| ATOM | 193 | C | MET A | 40 | 3.845 | 48.286 | 31.277 | 1.00 | 0.00 | XXXX | 193 |
| ATOM | 194 | O | MET A | 40 | 4.851 | 48.241 | 30.569 | 1.00 | 0.00 | XXXX | 194 |
| ATOM | 195 | CB | MET A | 40 | 3.285 | 46.475 | 32.910 | 1.00 | 0.00 | XXXX | 195 |
| ATOM | 196 | CG | MET A | 40 | 4.026 | 45.399 | 32.122 | 1.00 | 0.00 | XXXX | 196 |
| ATOM | 197 | SD | MET A | 40 | 3.421 | 43.720 | 32.378 | 1.00 | 0.00 | XXXX | 197 |
| ATOM | 198 | CE | MET A | 40 | 1.832 | 43.799 | 31.556 | 1.00 | 0.00 | XXXX | 198 |
| ATOM | 199 | N | ALA A | 41 | 2.659 | 48.694 | 30.832 | 1.00 | 0.00 | XXXX | 199 |
| ATOM | 200 | CA | ALA A | 41 | 2.467 | 49.167 | 29.464 | 1.00 | 0.00 | XXXX | 200 |

| | | | | | | | | | | |
|---|---|---|---|---|---|---|---|---|---|---|
| ATOM | 201 | C | ALA A | 41 | 3.364 | 50.363 | 29.163 | 1.00 | 0.00 | XXXX | 201 |
| ATOM | 202 | O | ALA A | 41 | 3.978 | 50.438 | 28.098 | 1.00 | 0.00 | XXXX | 202 |
| ATOM | 203 | CB | ALA A | 41 | 1.007 | 49.527 | 29.225 | 1.00 | 0.00 | XXXX | 203 |
| ATOM | 204 | N | ILE A | 42 | 3.430 | 51.298 | 30.105 | 1.00 | 0.00 | XXXX | 204 |
| ATOM | 205 | CA | ILE A | 42 | 4.288 | 52.469 | 29.968 | 1.00 | 0.00 | XXXX | 205 |
| ATOM | 206 | C | ILE A | 42 | 5.761 | 52.081 | 29.835 | 1.00 | 0.00 | XXXX | 206 |
| ATOM | 207 | O | ILE A | 42 | 6.484 | 52.630 | 29.002 | 1.00 | 0.00 | XXXX | 207 |
| ATOM | 208 | CB | ILE A | 42 | 4.125 | 53.425 | 31.165 | 1.00 | 0.00 | XXXX | 208 |
| ATOM | 209 | CG1 | ILE A | 42 | 2.734 | 54.063 | 31.151 | 1.00 | 0.00 | XXXX | 209 |
| ATOM | 210 | CD1 | ILE A | 42 | 2.400 | 54.828 | 32.416 | 1.00 | 0.00 | XXXX | 210 |
| ATOM | 211 | CG2 | ILE A | 42 | 5.208 | 54.494 | 31.148 | 1.00 | 0.00 | XXXX | 211 |
| ATOM | 212 | N | GLU A | 43 | 6.202 | 51.136 | 30.661 | 1.00 | 0.00 | XXXX | 212 |
| ATOM | 213 | CA | GLU A | 43 | 7.585 | 50.670 | 30.618 | 1.00 | 0.00 | XXXX | 213 |
| ATOM | 214 | C | GLU A | 43 | 7.904 | 49.990 | 29.291 | 1.00 | 0.00 | XXXX | 214 |
| ATOM | 215 | O | GLU A | 43 | 8.980 | 50.189 | 28.724 | 1.00 | 0.00 | XXXX | 215 |
| ATOM | 216 | CB | GLU A | 43 | 7.868 | 49.711 | 31.776 | 1.00 | 0.00 | XXXX | 216 |
| ATOM | 217 | CG | GLU A | 43 | 9.267 | 49.117 | 31.751 | 1.00 | 0.00 | XXXX | 217 |
| ATOM | 218 | CD | GLU A | 43 | 9.543 | 48.214 | 32.938 | 1.00 | 0.00 | XXXX | 218 |
| ATOM | 219 | OE1 | GLU A | 43 | 8.833 | 47.196 | 33.093 | 1.00 | 0.00 | XXXX | 219 |
| ATOM | 220 | OE2 | GLU A | 43 | 10.470 | 48.521 | 33.716 | 1.00 | 0.00 | XXXX | 220 |
| ATOM | 221 | N | GLU A | 44 | 6.965 | 49.184 | 28.804 | 1.00 | 0.00 | XXXX | 221 |
| ATOM | 222 | CA | GLU A | 44 | 7.131 | 48.492 | 27.529 | 1.00 | 0.00 | XXXX | 222 |
| ATOM | 223 | C | GLU A | 44 | 7.279 | 49.491 | 26.387 | 1.00 | 0.00 | XXXX | 223 |
| ATOM | 224 | O | GLU A | 44 | 8.181 | 49.375 | 25.557 | 1.00 | 0.00 | XXXX | 224 |
| ATOM | 225 | CB | GLU A | 44 | 5.946 | 47.560 | 27.258 | 1.00 | 0.00 | XXXX | 225 |
| ATOM | 226 | CG | GLU A | 44 | 5.854 | 46.373 | 28.199 | 1.00 | 0.00 | XXXX | 226 |
| ATOM | 227 | CD | GLU A | 44 | 4.640 | 45.508 | 27.926 | 1.00 | 0.00 | XXXX | 227 |
| ATOM | 228 | OE1 | GLU A | 44 | 3.855 | 45.850 | 27.017 | 1.00 | 0.00 | XXXX | 228 |
| ATOM | 229 | OE2 | GLU A | 44 | 4.470 | 44.485 | 28.622 | 1.00 | 0.00 | XXXX | 229 |
| ATOM | 230 | N | ILE A | 45 | 6.385 | 50.474 | 26.355 | 1.00 | 0.00 | XXXX | 230 |
| ATOM | 231 | CA | ILE A | 45 | 6.404 | 51.507 | 25.325 | 1.00 | 0.00 | XXXX | 231 |
| ATOM | 232 | C | ILE A | 45 | 7.682 | 52.345 | 25.371 | 1.00 | 0.00 | XXXX | 232 |
| ATOM | 233 | O | ILE A | 45 | 8.240 | 52.695 | 24.329 | 1.00 | 0.00 | XXXX | 233 |
| ATOM | 234 | CB | ILE A | 45 | 5.181 | 52.435 | 25.450 | 1.00 | 0.00 | XXXX | 234 |
| ATOM | 235 | CG1 | ILE A | 45 | 3.903 | 51.671 | 25.093 | 1.00 | 0.00 | XXXX | 235 |
| ATOM | 236 | CG2 | ILE A | 45 | 5.340 | 53.652 | 24.554 | 1.00 | 0.00 | XXXX | 236 |
| ATOM | 237 | CD1 | ILE A | 45 | 2.625 | 52.407 | 25.438 | 1.00 | 0.00 | XXXX | 237 |
| ATOM | 238 | N | ASN A | 46 | 8.141 | 52.669 | 26.576 | 1.00 | 0.00 | XXXX | 238 |
| ATOM | 239 | CA | ASN A | 46 | 9.368 | 53.443 | 26.735 | 1.00 | 0.00 | XXXX | 239 |
| ATOM | 240 | C | ASN A | 46 | 10.576 | 52.680 | 26.206 | 1.00 | 0.00 | XXXX | 240 |
| ATOM | 241 | O | ASN A | 46 | 11.473 | 53.261 | 25.595 | 1.00 | 0.00 | XXXX | 241 |
| ATOM | 242 | CB | ASN A | 46 | 9.585 | 53.821 | 28.201 | 1.00 | 0.00 | XXXX | 242 |
| ATOM | 243 | CG | ASN A | 46 | 8.711 | 54.981 | 28.639 | 1.00 | 0.00 | XXXX | 243 |
| ATOM | 244 | OD1 | ASN A | 46 | 8.231 | 55.757 | 27.812 | 1.00 | 0.00 | XXXX | 244 |
| ATOM | 245 | ND2 | ASN A | 46 | 8.507 | 55.111 | 29.946 | 1.00 | 0.00 | XXXX | 245 |
| ATOM | 246 | N | ASN A | 47 | 10.589 | 51.373 | 26.444 | 1.00 | 0.00 | XXXX | 246 |
| ATOM | 247 | CA | ASN A | 47 | 11.667 | 50.518 | 25.966 | 1.00 | 0.00 | XXXX | 247 |
| ATOM | 248 | C | ASN A | 47 | 11.651 | 50.374 | 24.447 | 1.00 | 0.00 | XXXX | 248 |
| ATOM | 249 | O | ASN A | 47 | 12.659 | 50.009 | 23.844 | 1.00 | 0.00 | XXXX | 249 |
| ATOM | 250 | CB | ASN A | 47 | 11.586 | 49.139 | 26.625 | 1.00 | 0.00 | XXXX | 250 |
| ATOM | 251 | CG | ASN A | 47 | 11.934 | 49.177 | 28.101 | 1.00 | 0.00 | XXXX | 251 |
| ATOM | 252 | OD1 | ASN A | 47 | 12.550 | 50.128 | 28.582 | 1.00 | 0.00 | XXXX | 252 |
| ATOM | 253 | ND2 | ASN A | 47 | 11.540 | 48.138 | 28.828 | 1.00 | 0.00 | XXXX | 253 |
| ATOM | 254 | N | ASN A | 48 | 10.503 | 50.655 | 23.834 | 1.00 | 0.00 | XXXX | 254 |
| ATOM | 255 | CA | ASN A | 48 | 10.372 | 50.589 | 22.379 | 1.00 | 0.00 | XXXX | 255 |
| ATOM | 256 | C | ASN A | 48 | 10.612 | 51.925 | 21.682 | 1.00 | 0.00 | XXXX | 256 |
| ATOM | 257 | O | ASN A | 48 | 10.320 | 52.071 | 20.496 | 1.00 | 0.00 | XXXX | 257 |
| ATOM | 258 | CB | ASN A | 48 | 8.986 | 50.066 | 21.994 | 1.00 | 0.00 | XXXX | 258 |
| ATOM | 259 | CG | ASN A | 48 | 8.822 | 48.587 | 22.271 | 1.00 | 0.00 | XXXX | 259 |
| ATOM | 260 | OD1 | ASN A | 48 | 9.765 | 47.914 | 22.682 | 1.00 | 0.00 | XXXX | 260 |
| ATOM | 261 | ND2 | ASN A | 48 | 7.618 | 48.072 | 22.042 | 1.00 | 0.00 | XXXX | 261 |
| ATOM | 262 | N | GLY A | 49 | 11.142 | 52.898 | 22.416 | 1.00 | 0.00 | XXXX | 262 |
| ATOM | 263 | CA | GLY A | 49 | 11.456 | 54.193 | 21.840 | 1.00 | 0.00 | XXXX | 263 |
| ATOM | 264 | C | GLY A | 49 | 10.443 | 55.271 | 22.174 | 1.00 | 0.00 | XXXX | 264 |
| ATOM | 265 | O | GLY A | 49 | 10.497 | 56.376 | 21.634 | 1.00 | 0.00 | XXXX | 265 |
| ATOM | 266 | N | GLY A | 50 | 9.512 | 54.944 | 23.064 | 1.00 | 0.00 | XXXX | 266 |
| ATOM | 267 | CA | GLY A | 50 | 8.574 | 55.921 | 23.588 | 1.00 | 0.00 | XXXX | 267 |
| ATOM | 268 | C | GLY A | 50 | 7.596 | 56.483 | 22.573 | 1.00 | 0.00 | XXXX | 268 |
| ATOM | 269 | O | GLY A | 50 | 7.202 | 55.806 | 21.624 | 1.00 | 0.00 | XXXX | 269 |
| ATOM | 270 | N | VAL A | 51 | 7.201 | 57.735 | 22.782 | 1.00 | 0.00 | XXXX | 270 |
| ATOM | 271 | CA | VAL A | 51 | 6.164 | 58.361 | 21.974 | 1.00 | 0.00 | XXXX | 271 |
| ATOM | 272 | C | VAL A | 51 | 6.596 | 59.734 | 21.474 | 1.00 | 0.00 | XXXX | 272 |
| ATOM | 273 | O | VAL A | 51 | 6.963 | 60.600 | 22.268 | 1.00 | 0.00 | XXXX | 273 |
| ATOM | 274 | CB | VAL A | 51 | 4.847 | 58.511 | 22.765 | 1.00 | 0.00 | XXXX | 274 |
| ATOM | 275 | CG1 | VAL A | 51 | 3.848 | 59.351 | 21.981 | 1.00 | 0.00 | XXXX | 275 |
| ATOM | 276 | CG2 | VAL A | 51 | 4.268 | 57.145 | 23.104 | 1.00 | 0.00 | XXXX | 276 |
| ATOM | 277 | N | LEU A | 52 | 6.539 | 59.927 | 20.158 | 1.00 | 0.00 | XXXX | 277 |
| ATOM | 278 | CA | LEU A | 52 | 6.974 | 61.174 | 19.534 | 1.00 | 0.00 | XXXX | 278 |
| ATOM | 279 | C | LEU A | 52 | 8.385 | 61.565 | 19.960 | 1.00 | 0.00 | XXXX | 279 |

-continued

| | | | | | | | | | | |
|---|---|---|---|---|---|---|---|---|---|---|
| ATOM | 280 | O | LEU A | 52 | 8.683 | 62.746 | 20.147 | 1.00 | 0.00 | XXXX | 280 |
| ATOM | 281 | CB | LEU A | 52 | 5.994 | 62.303 | 19.864 | 1.00 | 0.00 | XXXX | 281 |
| ATOM | 282 | CG | LEU A | 52 | 4.555 | 62.082 | 19.393 | 1.00 | 0.00 | XXXX | 282 |
| ATOM | 283 | CD1 | LEU A | 52 | 3.678 | 63.276 | 19.742 | 1.00 | 0.00 | XXXX | 283 |
| ATOM | 284 | CD2 | LEU A | 52 | 4.531 | 61.806 | 17.898 | 1.00 | 0.00 | XXXX | 284 |
| ATOM | 285 | N | GLY A | 53 | 9.241 | 60.559 | 20.112 | 1.00 | 0.00 | XXXX | 285 |
| ATOM | 286 | CA | GLY A | 53 | 10.626 | 60.774 | 20.484 | 1.00 | 0.00 | XXXX | 286 |
| ATOM | 287 | C | GLY A | 53 | 10.827 | 61.113 | 21.948 | 1.00 | 0.00 | XXXX | 287 |
| ATOM | 288 | O | GLY A | 53 | 11.914 | 61.526 | 22.352 | 1.00 | 0.00 | XXXX | 288 |
| ATOM | 289 | N | LYS A | 54 | 9.776 | 60.952 | 22.745 | 1.00 | 0.00 | XXXX | 289 |
| ATOM | 290 | CA | LYS A | 54 | 9.863 | 61.212 | 24.177 | 1.00 | 0.00 | XXXX | 290 |
| ATOM | 291 | C | LYS A | 54 | 9.467 | 59.988 | 24.995 | 1.00 | 0.00 | XXXX | 291 |
| ATOM | 292 | O | LYS A | 54 | 8.652 | 59.176 | 24.560 | 1.00 | 0.00 | XXXX | 292 |
| ATOM | 293 | CB | LYS A | 54 | 8.981 | 62.405 | 24.562 | 1.00 | 0.00 | XXXX | 293 |
| ATOM | 294 | CG | LYS A | 54 | 9.345 | 63.704 | 23.861 | 1.00 | 0.00 | XXXX | 294 |
| ATOM | 295 | CD | LYS A | 54 | 8.379 | 64.821 | 24.230 | 1.00 | 0.00 | XXXX | 295 |
| ATOM | 296 | CE | LYS A | 54 | 8.757 | 66.125 | 23.550 | 1.00 | 0.00 | XXXX | 296 |
| ATOM | 297 | NZ | LYS A | 54 | 8.692 | 66.002 | 22.069 | 1.00 | 0.00 | XXXX | 297 |
| ATOM | 298 | N | LYS A | 55 | 10.051 | 59.860 | 26.182 | 1.00 | 0.00 | XXXX | 298 |
| ATOM | 299 | CA | LYS A | 55 | 9.657 | 58.811 | 27.112 | 1.00 | 0.00 | XXXX | 299 |
| ATOM | 300 | C | LYS A | 55 | 8.435 | 59.263 | 27.905 | 1.00 | 0.00 | XXXX | 300 |
| ATOM | 301 | O | LYS A | 55 | 8.241 | 60.457 | 28.130 | 1.00 | 0.00 | XXXX | 301 |
| ATOM | 302 | CB | LYS A | 55 | 10.805 | 58.458 | 28.059 | 1.00 | 0.00 | XXXX | 302 |
| ATOM | 303 | CG | LYS A | 55 | 12.028 | 57.868 | 27.372 | 1.00 | 0.00 | XXXX | 303 |
| ATOM | 304 | CD | LYS A | 55 | 11.638 | 56.776 | 26.389 | 1.00 | 0.00 | XXXX | 304 |
| ATOM | 305 | CE | LYS A | 55 | 12.860 | 56.202 | 25.691 | 1.00 | 0.00 | XXXX | 305 |
| ATOM | 306 | NZ | LYS A | 55 | 13.765 | 55.509 | 26.649 | 1.00 | 0.00 | XXXX | 306 |
| ATOM | 307 | N | LEU A | 56 | 7.612 | 58.310 | 28.327 | 1.00 | 0.00 | XXXX | 307 |
| ATOM | 308 | CA | LEU A | 56 | 6.458 | 58.630 | 29.158 | 1.00 | 0.00 | XXXX | 308 |
| ATOM | 309 | C | LEU A | 56 | 6.854 | 58.655 | 30.629 | 1.00 | 0.00 | XXXX | 309 |
| ATOM | 310 | O | LEU A | 56 | 7.536 | 57.751 | 31.113 | 1.00 | 0.00 | XXXX | 310 |
| ATOM | 311 | CB | LEU A | 56 | 5.329 | 57.623 | 28.929 | 1.00 | 0.00 | XXXX | 311 |
| ATOM | 312 | CG | LEU A | 56 | 4.860 | 57.430 | 27.485 | 1.00 | 0.00 | XXXX | 312 |
| ATOM | 313 | CD1 | LEU A | 56 | 3.893 | 56.260 | 27.387 | 1.00 | 0.00 | XXXX | 313 |
| ATOM | 314 | CD2 | LEU A | 56 | 4.221 | 58.703 | 26.953 | 1.00 | 0.00 | XXXX | 314 |
| ATOM | 315 | N | GLU A | 57 | 6.428 | 59.697 | 31.334 | 1.00 | 0.00 | XXXX | 315 |
| ATOM | 316 | CA | GLU A | 57 | 6.711 | 59.822 | 32.759 | 1.00 | 0.00 | XXXX | 316 |
| ATOM | 317 | C | GLU A | 57 | 5.419 | 59.775 | 33.562 | 1.00 | 0.00 | XXXX | 317 |
| ATOM | 318 | O | GLU A | 57 | 4.650 | 60.735 | 33.564 | 1.00 | 0.00 | XXXX | 318 |
| ATOM | 319 | CB | GLU A | 57 | 7.466 | 61.119 | 33.059 | 1.00 | 0.00 | XXXX | 319 |
| ATOM | 320 | CG | GLU A | 57 | 7.685 | 61.366 | 34.546 | 1.00 | 0.00 | XXXX | 320 |
| ATOM | 321 | CD | GLU A | 57 | 8.491 | 62.621 | 34.824 | 1.00 | 0.00 | XXXX | 321 |
| ATOM | 322 | OE1 | GLU A | 57 | 8.832 | 63.340 | 33.861 | 1.00 | 0.00 | XXXX | 322 |
| ATOM | 323 | OE2 | GLU A | 57 | 8.784 | 62.890 | 36.008 | 1.00 | 0.00 | XXXX | 323 |
| ATOM | 324 | N | PRO A | 58 | 5.180 | 58.651 | 34.250 | 1.00 | 0.00 | XXXX | 324 |
| ATOM | 325 | CA | PRO A | 58 | 3.942 | 58.471 | 35.014 | 1.00 | 0.00 | XXXX | 325 |
| ATOM | 326 | C | PRO A | 58 | 3.925 | 59.272 | 36.315 | 1.00 | 0.00 | XXXX | 326 |
| ATOM | 327 | O | PRO A | 58 | 4.907 | 59.288 | 37.059 | 1.00 | 0.00 | XXXX | 327 |
| ATOM | 328 | CB | PRO A | 58 | 3.924 | 56.968 | 35.299 | 1.00 | 0.00 | XXXX | 328 |
| ATOM | 329 | CG | PRO A | 58 | 5.360 | 56.570 | 35.305 | 1.00 | 0.00 | XXXX | 329 |
| ATOM | 330 | CD | PRO A | 58 | 6.067 | 57.478 | 34.331 | 1.00 | 0.00 | XXXX | 330 |
| ATOM | 331 | N | ILE A | 59 | 2.804 | 59.935 | 36.574 | 1.00 | 0.00 | XXXX | 331 |
| ATOM | 332 | CA | ILE A | 59 | 2.580 | 60.622 | 37.838 | 1.00 | 0.00 | XXXX | 332 |
| ATOM | 333 | C | ILE A | 59 | 1.459 | 59.909 | 38.580 | 1.00 | 0.00 | XXXX | 333 |
| ATOM | 334 | O | ILE A | 59 | 0.296 | 60.010 | 38.196 | 1.00 | 0.00 | XXXX | 334 |
| ATOM | 335 | CB | ILE A | 59 | 2.211 | 62.102 | 37.636 | 1.00 | 0.00 | XXXX | 335 |
| ATOM | 336 | CG1 | ILE A | 59 | 3.225 | 62.788 | 36.716 | 1.00 | 0.00 | XXXX | 336 |
| ATOM | 337 | CD1 | ILE A | 59 | 4.639 | 62.784 | 37.249 | 1.00 | 0.00 | XXXX | 337 |
| ATOM | 338 | CG2 | ILE A | 59 | 2.116 | 62.815 | 38.978 | 1.00 | 0.00 | XXXX | 338 |
| ATOM | 339 | N | VAL A | 60 | 1.812 | 59.184 | 39.637 | 1.00 | 0.00 | XXXX | 339 |
| ATOM | 340 | CA | VAL A | 60 | 0.851 | 58.332 | 40.331 | 1.00 | 0.00 | XXXX | 340 |
| ATOM | 341 | C | VAL A | 60 | 0.192 | 59.052 | 41.503 | 1.00 | 0.00 | XXXX | 341 |
| ATOM | 342 | O | VAL A | 60 | 0.871 | 59.607 | 42.369 | 1.00 | 0.00 | XXXX | 342 |
| ATOM | 343 | CB | VAL A | 60 | 1.518 | 57.041 | 40.844 | 1.00 | 0.00 | XXXX | 343 |
| ATOM | 344 | CG1 | VAL A | 60 | 0.527 | 56.209 | 41.647 | 1.00 | 0.00 | XXXX | 344 |
| ATOM | 345 | CG2 | VAL A | 60 | 2.074 | 56.238 | 39.682 | 1.00 | 0.00 | XXXX | 345 |
| ATOM | 346 | N | GLU A | 61 | −1.137 | 59.036 | 41.521 | 1.00 | 0.00 | XXXX | 346 |
| ATOM | 347 | CA | GLU A | 61 | −1.906 | 59.687 | 42.577 | 1.00 | 0.00 | XXXX | 347 |
| ATOM | 348 | C | GLU A | 61 | −2.923 | 58.734 | 43.197 | 1.00 | 0.00 | XXXX | 348 |
| ATOM | 349 | O | GLU A | 61 | −3.594 | 57.980 | 42.494 | 1.00 | 0.00 | XXXX | 349 |
| ATOM | 350 | CB | GLU A | 61 | −2.620 | 60.928 | 42.034 | 1.00 | 0.00 | XXXX | 350 |
| ATOM | 351 | CG | GLU A | 61 | −1.688 | 62.025 | 41.546 | 1.00 | 0.00 | XXXX | 351 |
| ATOM | 352 | CD | GLU A | 61 | −0.884 | 62.648 | 42.672 | 1.00 | 0.00 | XXXX | 352 |
| ATOM | 353 | OE1 | GLU A | 61 | −1.361 | 62.627 | 43.827 | 1.00 | 0.00 | XXXX | 353 |
| ATOM | 354 | OE2 | GLU A | 61 | 0.225 | 63.159 | 42.403 | 1.00 | 0.00 | XXXX | 354 |
| ATOM | 355 | N | ASP A | 62 | −3.031 | 58.771 | 44.520 | 1.00 | 0.00 | XXXX | 355 |
| ATOM | 356 | CA | ASP A | 62 | −4.011 | 57.957 | 45.229 | 1.00 | 0.00 | XXXX | 356 |
| ATOM | 357 | C | ASP A | 62 | −5.384 | 58.628 | 45.227 | 1.00 | 0.00 | XXXX | 357 |
| ATOM | 358 | O | ASP A | 62 | −5.537 | 59.743 | 45.725 | 1.00 | 0.00 | XXXX | 358 |

-continued

| ATOM | 359 | CB | ASP A | 62 | −3.545 | 57.697 | 46.666 | 1.00 | 0.00 | XXXX | 359 |
| ATOM | 360 | CG | ASP A | 62 | −4.533 | 56.866 | 47.464 | 1.00 | 0.00 | XXXX | 360 |
| ATOM | 361 | OD1 | ASP A | 62 | −5.352 | 56.148 | 46.852 | 1.00 | 0.00 | XXXX | 361 |
| ATOM | 362 | OD2 | ASP A | 62 | −4.489 | 56.932 | 48.711 | 1.00 | 0.00 | XXXX | 362 |
| ATOM | 363 | N | GLY A | 63 | −6.377 | 57.947 | 44.661 | 1.00 | 0.00 | XXXX | 363 |
| ATOM | 364 | CA | GLY A | 63 | −7.744 | 58.439 | 44.683 | 1.00 | 0.00 | XXXX | 364 |
| ATOM | 365 | C | GLY A | 63 | −8.432 | 58.105 | 45.995 | 1.00 | 0.00 | XXXX | 365 |
| ATOM | 366 | O | GLY A | 63 | −9.473 | 58.673 | 46.327 | 1.00 | 0.00 | XXXX | 366 |
| ATOM | 367 | N | ALA A | 64 | −7.847 | 57.164 | 46.731 | 1.00 | 0.00 | XXXX | 367 |
| ATOM | 368 | CA | ALA A | 64 | −8.236 | 56.869 | 48.108 | 1.00 | 0.00 | XXXX | 368 |
| ATOM | 369 | C | ALA A | 64 | −9.689 | 56.422 | 48.273 | 1.00 | 0.00 | XXXX | 369 |
| ATOM | 370 | O | ALA A | 64 | −10.279 | 56.626 | 49.333 | 1.00 | 0.00 | XXXX | 370 |
| ATOM | 371 | CB | ALA A | 64 | −7.969 | 58.085 | 48.987 | 1.00 | 0.00 | XXXX | 371 |
| ATOM | 372 | N | SER A | 65 | −10.257 | 55.806 | 47.239 | 1.00 | 0.00 | XXXX | 372 |
| ATOM | 373 | CA | SER A | 65 | −11.644 | 55.342 | 47.289 | 1.00 | 0.00 | XXXX | 373 |
| ATOM | 374 | C | SER A | 65 | −12.588 | 56.471 | 47.702 | 1.00 | 0.00 | XXXX | 374 |
| ATOM | 375 | O | SER A | 65 | −13.645 | 56.233 | 48.288 | 1.00 | 0.00 | XXXX | 375 |
| ATOM | 376 | CB | SER A | 65 | −11.784 | 54.159 | 48.253 | 1.00 | 0.00 | XXXX | 376 |
| ATOM | 377 | OG | SER A | 65 | −10.884 | 53.113 | 47.925 | 1.00 | 0.00 | XXXX | 377 |
| ATOM | 378 | N | ASP A | 66 | −12.193 | 57.699 | 47.389 | 1.00 | 0.00 | XXXX | 378 |
| ATOM | 379 | CA | ASP A | 66 | −12.928 | 58.884 | 47.812 | 1.00 | 0.00 | XXXX | 379 |
| ATOM | 380 | C | ASP A | 66 | −13.152 | 59.797 | 46.616 | 1.00 | 0.00 | XXXX | 380 |
| ATOM | 381 | O | ASP A | 66 | −12.208 | 60.362 | 46.066 | 1.00 | 0.00 | XXXX | 381 |
| ATOM | 382 | CB | ASP A | 66 | −12.176 | 59.623 | 48.921 | 1.00 | 0.00 | XXXX | 382 |
| ATOM | 383 | CG | ASP A | 66 | −12.942 | 60.821 | 49.448 | 1.00 | 0.00 | XXXX | 383 |
| ATOM | 384 | OD1 | ASP A | 66 | −13.940 | 60.620 | 50.172 | 1.00 | 0.00 | XXXX | 384 |
| ATOM | 385 | OD2 | ASP A | 66 | −12.546 | 61.964 | 49.136 | 1.00 | 0.00 | XXXX | 385 |
| ATOM | 386 | N | TRP A | 67 | −14.410 | 59.924 | 46.212 | 1.00 | 0.00 | XXXX | 386 |
| ATOM | 387 | CA | TRP A | 67 | −14.755 | 60.579 | 44.956 | 1.00 | 0.00 | XXXX | 387 |
| ATOM | 388 | C | TRP A | 67 | −14.342 | 62.052 | 44.912 | 1.00 | 0.00 | XXXX | 388 |
| ATOM | 389 | O | TRP A | 67 | −13.872 | 62.528 | 43.879 | 1.00 | 0.00 | XXXX | 389 |
| ATOM | 390 | CB | TRP A | 67 | −16.255 | 60.422 | 44.687 | 1.00 | 0.00 | XXXX | 390 |
| ATOM | 391 | CG | TRP A | 67 | −16.792 | 59.082 | 45.135 | 1.00 | 0.00 | XXXX | 391 |
| ATOM | 392 | CD1 | TRP A | 67 | −17.999 | 58.837 | 45.721 | 1.00 | 0.00 | XXXX | 392 |
| ATOM | 393 | CD2 | TRP A | 67 | −16.122 | 57.812 | 45.054 | 1.00 | 0.00 | XXXX | 393 |
| ATOM | 394 | NE1 | TRP A | 67 | −18.130 | 57.495 | 45.996 | 1.00 | 0.00 | XXXX | 394 |
| ATOM | 395 | CE2 | TRP A | 67 | −16.990 | 56.846 | 45.600 | 1.00 | 0.00 | XXXX | 395 |
| ATOM | 396 | CE3 | TRP A | 67 | −14.874 | 57.400 | 44.571 | 1.00 | 0.00 | XXXX | 396 |
| ATOM | 397 | CZ2 | TRP A | 67 | −16.653 | 55.498 | 45.674 | 1.00 | 0.00 | XXXX | 397 |
| ATOM | 398 | CZ3 | TRP A | 67 | −14.541 | 56.055 | 44.649 | 1.00 | 0.00 | XXXX | 398 |
| ATOM | 399 | CH2 | TRP A | 67 | −15.428 | 55.123 | 45.195 | 1.00 | 0.00 | XXXX | 399 |
| ATOM | 400 | N | PRO A | 68 | −14.516 | 62.782 | 46.026 | 1.00 | 0.00 | XXXX | 400 |
| ATOM | 401 | CA | PRO A | 68 | −13.989 | 64.150 | 46.065 | 1.00 | 0.00 | XXXX | 401 |
| ATOM | 402 | C | PRO A | 68 | −12.471 | 64.195 | 45.881 | 1.00 | 0.00 | XXXX | 402 |
| ATOM | 403 | O | PRO A | 68 | −11.958 | 65.106 | 45.228 | 1.00 | 0.00 | XXXX | 403 |
| ATOM | 404 | CB | PRO A | 68 | −14.390 | 64.638 | 47.458 | 1.00 | 0.00 | XXXX | 404 |
| ATOM | 405 | CG | PRO A | 68 | −15.604 | 63.837 | 47.792 | 1.00 | 0.00 | XXXX | 405 |
| ATOM | 406 | CD | PRO A | 68 | −15.345 | 62.479 | 47.205 | 1.00 | 0.00 | XXXX | 406 |
| ATOM | 407 | N | THR A | 69 | −11.766 | 63.221 | 46.450 | 1.00 | 0.00 | XXXX | 407 |
| ATOM | 408 | CA | THR A | 69 | −10.319 | 63.126 | 46.283 | 1.00 | 0.00 | XXXX | 408 |
| ATOM | 409 | C | THR A | 69 | −9.939 | 62.873 | 44.827 | 1.00 | 0.00 | XXXX | 409 |
| ATOM | 410 | O | THR A | 69 | −8.962 | 63.433 | 44.330 | 1.00 | 0.00 | XXXX | 410 |
| ATOM | 411 | CB | THR A | 69 | −9.717 | 62.011 | 47.158 | 1.00 | 0.00 | XXXX | 411 |
| ATOM | 412 | OG1 | THR A | 69 | −9.986 | 62.287 | 48.537 | 1.00 | 0.00 | XXXX | 412 |
| ATOM | 413 | CG2 | THR A | 69 | −8.211 | 61.929 | 46.950 | 1.00 | 0.00 | XXXX | 413 |
| ATOM | 414 | N | PHE A | 70 | −10.709 | 62.025 | 44.152 | 1.00 | 0.00 | XXXX | 414 |
| ATOM | 415 | CA | PHE A | 70 | −10.488 | 61.764 | 42.732 | 1.00 | 0.00 | XXXX | 415 |
| ATOM | 416 | C | PHE A | 70 | −10.576 | 63.052 | 41.923 | 1.00 | 0.00 | XXXX | 416 |
| ATOM | 417 | O | PHE A | 70 | −9.758 | 63.294 | 41.036 | 1.00 | 0.00 | XXXX | 417 |
| ATOM | 418 | CB | PHE A | 70 | −11.495 | 60.742 | 42.199 | 1.00 | 0.00 | XXXX | 418 |
| ATOM | 419 | CG | PHE A | 70 | −11.016 | 59.320 | 42.276 | 1.00 | 0.00 | XXXX | 419 |
| ATOM | 420 | CD1 | PHE A | 70 | −10.267 | 58.775 | 41.245 | 1.00 | 0.00 | XXXX | 420 |
| ATOM | 421 | CD2 | PHE A | 70 | −11.326 | 58.523 | 43.366 | 1.00 | 0.00 | XXXX | 421 |
| ATOM | 422 | CE1 | PHE A | 70 | −9.825 | 57.469 | 41.304 | 1.00 | 0.00 | XXXX | 422 |
| ATOM | 423 | CE2 | PHE A | 70 | −10.887 | 57.213 | 43.430 | 1.00 | 0.00 | XXXX | 423 |
| ATOM | 424 | CZ | PHE A | 70 | −10.137 | 56.685 | 42.397 | 1.00 | 0.00 | XXXX | 424 |
| ATOM | 425 | N | ALA A | 71 | −11.574 | 63.872 | 42.236 | 1.00 | 0.00 | XXXX | 425 |
| ATOM | 426 | CA | ALA A | 71 | −11.778 | 65.133 | 41.533 | 1.00 | 0.00 | XXXX | 426 |
| ATOM | 427 | C | ALA A | 71 | −10.596 | 66.077 | 41.732 | 1.00 | 0.00 | XXXX | 427 |
| ATOM | 428 | O | ALA A | 71 | −10.084 | 66.651 | 40.771 | 1.00 | 0.00 | XXXX | 428 |
| ATOM | 429 | CB | ALA A | 71 | −13.070 | 65.795 | 41.997 | 1.00 | 0.00 | XXXX | 429 |
| ATOM | 430 | N | GLU A | 72 | −10.164 | 66.231 | 42.979 | 1.00 | 0.00 | XXXX | 430 |
| ATOM | 431 | CA | GLU A | 72 | −9.043 | 67.112 | 43.295 | 1.00 | 0.00 | XXXX | 431 |
| ATOM | 432 | C | GLU A | 72 | −7.742 | 66.648 | 42.649 | 1.00 | 0.00 | XXXX | 432 |
| ATOM | 433 | O | GLU A | 72 | −6.979 | 67.458 | 42.127 | 1.00 | 0.00 | XXXX | 433 |
| ATOM | 434 | CB | GLU A | 72 | −8.859 | 67.219 | 44.810 | 1.00 | 0.00 | XXXX | 434 |
| ATOM | 435 | CG | GLU A | 72 | −9.931 | 68.039 | 45.501 | 1.00 | 0.00 | XXXX | 435 |
| ATOM | 436 | CD | GLU A | 72 | −10.079 | 69.427 | 44.906 | 1.00 | 0.00 | XXXX | 436 |
| ATOM | 437 | OE1 | GLU A | 72 | −9.060 | 70.140 | 44.797 | 1.00 | 0.00 | XXXX | 437 |

-continued

| | | | | | | | | | | |
|---|---|---|---|---|---|---|---|---|---|---|
| ATOM | 438 | OE2 | GLU A | 72 | −11.215 | 69.802 | 44.542 | 1.00 | 0.00 | XXXX | 438 |
| ATOM | 439 | N | LYS A | 73 | −7.491 | 65.343 | 42.694 | 1.00 | 0.00 | XXXX | 439 |
| ATOM | 440 | CA | LYS A | 73 | −6.282 | 64.782 | 42.100 | 1.00 | 0.00 | XXXX | 440 |
| ATOM | 441 | C | LYS A | 73 | −6.265 | 64.949 | 40.584 | 1.00 | 0.00 | XXXX | 441 |
| ATOM | 442 | O | LYS A | 73 | −5.221 | 65.240 | 40.000 | 1.00 | 0.00 | XXXX | 442 |
| ATOM | 443 | CB | LYS A | 73 | −6.133 | 63.304 | 42.469 | 1.00 | 0.00 | XXXX | 443 |
| ATOM | 444 | CG | LYS A | 73 | −5.843 | 63.075 | 43.942 | 1.00 | 0.00 | XXXX | 444 |
| ATOM | 445 | CD | LYS A | 73 | −4.531 | 63.736 | 44.336 | 1.00 | 0.00 | XXXX | 445 |
| ATOM | 446 | CE | LYS A | 73 | −4.183 | 63.467 | 45.789 | 1.00 | 0.00 | XXXX | 446 |
| ATOM | 447 | NZ | LYS A | 73 | −3.868 | 62.034 | 46.028 | 1.00 | 0.00 | XXXX | 447 |
| ATOM | 448 | N | ALA A | 74 | −7.419 | 64.761 | 39.951 | 1.00 | 0.00 | XXXX | 448 |
| ATOM | 449 | CA | ALA A | 74 | −7.535 | 64.941 | 38.507 | 1.00 | 0.00 | XXXX | 449 |
| ATOM | 450 | C | ALA A | 74 | −7.225 | 66.387 | 38.139 | 1.00 | 0.00 | XXXX | 450 |
| ATOM | 451 | O | ALA A | 74 | −6.584 | 66.664 | 37.124 | 1.00 | 0.00 | XXXX | 451 |
| ATOM | 452 | CB | ALA A | 74 | −8.924 | 64.551 | 38.026 | 1.00 | 0.00 | XXXX | 452 |
| ATOM | 453 | N | LYS A | 75 | −7.692 | 67.304 | 38.979 | 1.00 | 0.00 | XXXX | 453 |
| ATOM | 454 | CA | LYS A | 75 | −7.459 | 68.728 | 38.783 | 1.00 | 0.00 | XXXX | 454 |
| ATOM | 455 | C | LYS A | 75 | −5.971 | 69.060 | 38.875 | 1.00 | 0.00 | XXXX | 455 |
| ATOM | 456 | O | LYS A | 75 | −5.435 | 69.780 | 38.033 | 1.00 | 0.00 | XXXX | 456 |
| ATOM | 457 | CB | LYS A | 75 | −8.254 | 69.535 | 39.811 | 1.00 | 0.00 | XXXX | 457 |
| ATOM | 458 | CG | LYS A | 75 | −8.206 | 71.040 | 39.614 | 1.00 | 0.00 | XXXX | 458 |
| ATOM | 459 | CD | LYS A | 75 | −9.152 | 71.736 | 40.581 | 1.00 | 0.00 | XXXX | 459 |
| ATOM | 460 | CE | LYS A | 75 | −9.167 | 73.240 | 40.368 | 1.00 | 0.00 | XXXX | 460 |
| ATOM | 461 | NZ | LYS A | 75 | −10.122 | 73.916 | 41.292 | 1.00 | 0.00 | XXXX | 461 |
| ATOM | 462 | N | LYS A | 76 | −5.310 | 68.533 | 39.902 | 1.00 | 0.00 | XXXX | 462 |
| ATOM | 463 | CA | LYS A | 76 | −3.871 | 68.722 | 40.068 | 1.00 | 0.00 | XXXX | 463 |
| ATOM | 464 | C | LYS A | 76 | −3.085 | 68.143 | 38.893 | 1.00 | 0.00 | XXXX | 464 |
| ATOM | 465 | O | LYS A | 76 | −2.166 | 68.780 | 38.377 | 1.00 | 0.00 | XXXX | 465 |
| ATOM | 466 | CB | LYS A | 76 | −3.387 | 68.085 | 41.372 | 1.00 | 0.00 | XXXX | 466 |
| ATOM | 467 | CG | LYS A | 76 | −1.871 | 68.010 | 41.481 | 1.00 | 0.00 | XXXX | 467 |
| ATOM | 468 | CD | LYS A | 76 | −1.428 | 67.349 | 42.774 | 1.00 | 0.00 | XXXX | 468 |
| ATOM | 469 | CE | LYS A | 76 | −0.726 | 66.026 | 42.507 | 1.00 | 0.00 | XXXX | 469 |
| ATOM | 470 | NZ | LYS A | 76 | 0.521 | 66.197 | 41.707 | 1.00 | 0.00 | XXXX | 470 |
| ATOM | 471 | N | LEU A | 77 | −3.448 | 66.931 | 38.482 | 1.00 | 0.00 | XXXX | 471 |
| ATOM | 472 | CA | LEU A | 77 | −2.756 | 66.245 | 37.396 | 1.00 | 0.00 | XXXX | 472 |
| ATOM | 473 | C | LEU A | 77 | −2.831 | 67.021 | 36.083 | 1.00 | 0.00 | XXXX | 473 |
| ATOM | 474 | O | LEU A | 77 | −1.859 | 67.074 | 35.330 | 1.00 | 0.00 | XXXX | 474 |
| ATOM | 475 | CB | LEU A | 77 | −3.331 | 64.839 | 37.205 | 1.00 | 0.00 | XXXX | 475 |
| ATOM | 476 | CG | LEU A | 77 | −2.867 | 63.794 | 38.223 | 1.00 | 0.00 | XXXX | 476 |
| ATOM | 477 | CD1 | LEU A | 77 | −3.691 | 62.523 | 38.112 | 1.00 | 0.00 | XXXX | 477 |
| ATOM | 478 | CD2 | LEU A | 77 | −1.387 | 63.494 | 38.037 | 1.00 | 0.00 | XXXX | 478 |
| ATOM | 479 | N | LEU A | 78 | −3.986 | 67.621 | 35.813 | 1.00 | 0.00 | XXXX | 479 |
| ATOM | 480 | CA | LEU A | 78 | −4.183 | 68.369 | 34.576 | 1.00 | 0.00 | XXXX | 480 |
| ATOM | 481 | C | LEU A | 78 | −3.627 | 69.790 | 34.653 | 1.00 | 0.00 | XXXX | 481 |
| ATOM | 482 | O | LEU A | 78 | −3.013 | 70.276 | 33.703 | 1.00 | 0.00 | XXXX | 482 |
| ATOM | 483 | CB | LEU A | 78 | −5.669 | 68.414 | 34.209 | 1.00 | 0.00 | XXXX | 483 |
| ATOM | 484 | CG | LEU A | 78 | −6.311 | 67.077 | 33.830 | 1.00 | 0.00 | XXXX | 484 |
| ATOM | 485 | CD1 | LEU A | 78 | −7.799 | 67.250 | 33.566 | 1.00 | 0.00 | XXXX | 485 |
| ATOM | 486 | CD2 | LEU A | 78 | −5.615 | 66.468 | 32.620 | 1.00 | 0.00 | XXXX | 486 |
| ATOM | 487 | N | GLN A | 79 | −3.842 | 70.451 | 35.786 | 1.00 | 0.00 | XXXX | 487 |
| ATOM | 488 | CA | GLN A | 79 | −3.524 | 71.872 | 35.913 | 1.00 | 0.00 | XXXX | 488 |
| ATOM | 489 | C | GLN A | 79 | −2.118 | 72.151 | 36.446 | 1.00 | 0.00 | XXXX | 489 |
| ATOM | 490 | O | GLN A | 79 | −1.468 | 73.103 | 36.015 | 1.00 | 0.00 | XXXX | 490 |
| ATOM | 491 | CB | GLN A | 79 | −4.557 | 72.553 | 36.814 | 1.00 | 0.00 | XXXX | 491 |
| ATOM | 492 | CG | GLN A | 79 | −5.963 | 72.564 | 36.236 | 1.00 | 0.00 | XXXX | 492 |
| ATOM | 493 | CD | GLN A | 79 | −6.935 | 73.357 | 37.084 | 1.00 | 0.00 | XXXX | 493 |
| ATOM | 494 | OE1 | GLN A | 79 | −6.573 | 73.880 | 38.137 | 1.00 | 0.00 | XXXX | 494 |
| ATOM | 495 | NE2 | GLN A | 79 | −8.180 | 73.450 | 36.629 | 1.00 | 0.00 | XXXX | 495 |
| ATOM | 496 | N | LYS A | 80 | −1.647 | 71.326 | 37.374 | 1.00 | 0.00 | XXXX | 496 |
| ATOM | 497 | CA | LYS A | 80 | −0.332 | 71.538 | 37.972 | 1.00 | 0.00 | XXXX | 497 |
| ATOM | 498 | C | LYS A | 80 | 0.742 | 70.687 | 37.303 | 1.00 | 0.00 | XXXX | 498 |
| ATOM | 499 | O | LYS A | 80 | 1.794 | 71.193 | 36.909 | 1.00 | 0.00 | XXXX | 499 |
| ATOM | 500 | CB | LYS A | 80 | −0.374 | 71.242 | 39.472 | 1.00 | 0.00 | XXXX | 500 |
| ATOM | 501 | CG | LYS A | 80 | −1.262 | 72.189 | 40.260 | 1.00 | 0.00 | XXXX | 501 |
| ATOM | 502 | CD | LYS A | 80 | −0.718 | 73.608 | 40.215 | 1.00 | 0.00 | XXXX | 502 |
| ATOM | 503 | CE | LYS A | 80 | −1.543 | 74.548 | 41.078 | 1.00 | 0.00 | XXXX | 503 |
| ATOM | 504 | NZ | LYS A | 80 | −1.533 | 74.145 | 42.512 | 1.00 | 0.00 | XXXX | 504 |
| ATOM | 505 | N | ASP A | 81 | 0.474 | 69.392 | 37.180 | 1.00 | 0.00 | XXXX | 505 |
| ATOM | 506 | CA | ASP A | 81 | 1.423 | 68.479 | 36.560 | 1.00 | 0.00 | XXXX | 506 |
| ATOM | 507 | C | ASP A | 81 | 1.358 | 68.595 | 35.043 | 1.00 | 0.00 | XXXX | 507 |
| ATOM | 508 | O | ASP A | 81 | 2.311 | 68.249 | 34.343 | 1.00 | 0.00 | XXXX | 508 |
| ATOM | 509 | CB | ASP A | 81 | 1.145 | 67.040 | 36.997 | 1.00 | 0.00 | XXXX | 509 |
| ATOM | 510 | CG | ASP A | 81 | 1.313 | 66.844 | 38.491 | 1.00 | 0.00 | XXXX | 510 |
| ATOM | 511 | OD1 | ASP A | 81 | 2.389 | 67.192 | 39.020 | 1.00 | 0.00 | XXXX | 511 |
| ATOM | 512 | OD2 | ASP A | 81 | 0.366 | 66.348 | 39.136 | 1.00 | 0.00 | XXXX | 512 |
| ATOM | 513 | N | LYS A | 82 | 0.226 | 69.091 | 34.550 | 1.00 | 0.00 | XXXX | 513 |
| ATOM | 514 | CA | LYS A | 82 | −0.001 | 69.278 | 33.120 | 1.00 | 0.00 | XXXX | 514 |
| ATOM | 515 | C | LYS A | 82 | 0.251 | 67.997 | 32.332 | 1.00 | 0.00 | XXXX | 515 |
| ATOM | 516 | O | LYS A | 82 | 0.975 | 67.998 | 31.337 | 1.00 | 0.00 | XXXX | 516 |

-continued

| ATOM | 517 | CB  | LYS A | 82 | 0.876   | 70.411 | 32.585 | 1.00 | 0.00 | XXXX | 517 |
| ---- | --- | --- | ----- | -- | ------- | ------ | ------ | ---- | ---- | ---- | --- |
| ATOM | 518 | CG  | LYS A | 82 | 0.522   | 71.777 | 33.153 | 1.00 | 0.00 | XXXX | 518 |
| ATOM | 519 | CD  | LYS A | 82 | 1.492   | 72.846 | 32.682 | 1.00 | 0.00 | XXXX | 519 |
| ATOM | 520 | CE  | LYS A | 82 | 1.200   | 74.183 | 33.345 | 1.00 | 0.00 | XXXX | 520 |
| ATOM | 521 | NZ  | LYS A | 82 | −0.238  | 74.553 | 33.236 | 1.00 | 0.00 | XXXX | 521 |
| ATOM | 522 | N   | VAL A | 83 | −0.353  | 66.904 | 32.785 | 1.00 | 0.00 | XXXX | 522 |
| ATOM | 523 | CA  | VAL A | 83 | −0.227  | 65.629 | 32.095 | 1.00 | 0.00 | XXXX | 523 |
| ATOM | 524 | C   | VAL A | 83 | −0.980  | 65.670 | 30.768 | 1.00 | 0.00 | XXXX | 524 |
| ATOM | 525 | O   | VAL A | 83 | −1.882  | 66.486 | 30.581 | 1.00 | 0.00 | XXXX | 525 |
| ATOM | 526 | CB  | VAL A | 83 | −0.756  | 64.466 | 32.955 | 1.00 | 0.00 | XXXX | 526 |
| ATOM | 527 | CG1 | VAL A | 83 | −0.005  | 64.401 | 34.282 | 1.00 | 0.00 | XXXX | 527 |
| ATOM | 528 | CG2 | VAL A | 83 | −2.249  | 64.617 | 33.187 | 1.00 | 0.00 | XXXX | 528 |
| ATOM | 529 | N   | ALA A | 84 | −0.609  | 64.784 | 29.851 | 1.00 | 0.00 | XXXX | 529 |
| ATOM | 530 | CA  | ALA A | 84 | −1.257  | 64.723 | 28.547 | 1.00 | 0.00 | XXXX | 530 |
| ATOM | 531 | C   | ALA A | 84 | −2.525  | 63.884 | 28.619 | 1.00 | 0.00 | XXXX | 531 |
| ATOM | 532 | O   | ALA A | 84 | −3.400  | 63.987 | 27.760 | 1.00 | 0.00 | XXXX | 532 |
| ATOM | 533 | CB  | ALA A | 84 | −0.305  | 64.157 | 27.505 | 1.00 | 0.00 | XXXX | 533 |
| ATOM | 534 | N   | VAL A | 85 | −2.615  | 63.054 | 29.650 | 1.00 | 0.00 | XXXX | 534 |
| ATOM | 535 | CA  | VAL A | 85 | −3.725  | 62.122 | 29.788 | 1.00 | 0.00 | XXXX | 535 |
| ATOM | 536 | C   | VAL A | 85 | −3.748  | 61.525 | 31.189 | 1.00 | 0.00 | XXXX | 536 |
| ATOM | 537 | O   | VAL A | 85 | −2.717  | 61.453 | 31.859 | 1.00 | 0.00 | XXXX | 537 |
| ATOM | 538 | CB  | VAL A | 85 | −3.639  | 60.983 | 28.748 | 1.00 | 0.00 | XXXX | 538 |
| ATOM | 539 | CG1 | VAL A | 85 | −2.373  | 60.169 | 28.960 | 1.00 | 0.00 | XXXX | 539 |
| ATOM | 540 | CG2 | VAL A | 85 | −4.870  | 60.090 | 28.822 | 1.00 | 0.00 | XXXX | 540 |
| ATOM | 541 | N   | ILE A | 86 | −4.929  | 61.108 | 31.630 | 1.00 | 0.00 | XXXX | 541 |
| ATOM | 542 | CA  | ILE A | 86 | −5.068  | 60.401 | 32.894 | 1.00 | 0.00 | XXXX | 542 |
| ATOM | 543 | C   | ILE A | 86 | −5.610  | 58.998 | 32.668 | 1.00 | 0.00 | XXXX | 543 |
| ATOM | 544 | O   | ILE A | 86 | −6.639  | 58.820 | 32.016 | 1.00 | 0.00 | XXXX | 544 |
| ATOM | 545 | CB  | ILE A | 86 | −6.007  | 61.142 | 33.866 | 1.00 | 0.00 | XXXX | 545 |
| ATOM | 546 | CG1 | ILE A | 86 | −5.464  | 62.537 | 34.185 | 1.00 | 0.00 | XXXX | 546 |
| ATOM | 547 | CG2 | ILE A | 86 | −6.191  | 60.332 | 35.141 | 1.00 | 0.00 | XXXX | 547 |
| ATOM | 548 | CD1 | ILE A | 86 | −6.411  | 63.386 | 35.011 | 1.00 | 0.00 | XXXX | 548 |
| ATOM | 549 | N   | PHE A | 87 | −4.905  | 58.004 | 33.197 | 1.00 | 0.00 | XXXX | 549 |
| ATOM | 550 | CA  | PHE A | 87 | −5.420  | 56.642 | 33.252 | 1.00 | 0.00 | XXXX | 550 |
| ATOM | 551 | C   | PHE A | 87 | −5.904  | 56.363 | 34.674 | 1.00 | 0.00 | XXXX | 551 |
| ATOM | 552 | O   | PHE A | 87 | −5.130  | 56.486 | 35.622 | 1.00 | 0.00 | XXXX | 552 |
| ATOM | 553 | CB  | PHE A | 87 | −4.343  | 55.632 | 32.843 | 1.00 | 0.00 | XXXX | 553 |
| ATOM | 554 | CG  | PHE A | 87 | −3.706  | 55.926 | 31.512 | 1.00 | 0.00 | XXXX | 554 |
| ATOM | 555 | CD1 | PHE A | 87 | −4.340  | 55.579 | 30.331 | 1.00 | 0.00 | XXXX | 555 |
| ATOM | 556 | CD2 | PHE A | 87 | −2.471  | 56.549 | 31.446 | 1.00 | 0.00 | XXXX | 556 |
| ATOM | 557 | CE1 | PHE A | 87 | −3.753  | 55.850 | 29.106 | 1.00 | 0.00 | XXXX | 557 |
| ATOM | 558 | CE2 | PHE A | 87 | −1.878  | 56.822 | 30.225 | 1.00 | 0.00 | XXXX | 558 |
| ATOM | 559 | CZ  | PHE A | 87 | −2.521  | 56.472 | 29.054 | 1.00 | 0.00 | XXXX | 559 |
| ATOM | 560 | N   | GLY A | 88 | −7.169  | 55.992 | 34.839 | 1.00 | 0.00 | XXXX | 560 |
| ATOM | 561 | CA  | GLY A | 88 | −7.660  | 55.729 | 36.181 | 1.00 | 0.00 | XXXX | 561 |
| ATOM | 562 | C   | GLY A | 88 | −9.158  | 55.646 | 36.399 | 1.00 | 0.00 | XXXX | 562 |
| ATOM | 563 | O   | GLY A | 88 | −9.941  | 55.580 | 35.450 | 1.00 | 0.00 | XXXX | 563 |
| ATOM | 564 | N   | ALA A | 89 | −9.533  | 55.640 | 37.678 | 1.00 | 0.00 | XXXX | 564 |
| ATOM | 565 | CA  | ALA A | 89 | −10.914 | 55.502 | 38.142 | 1.00 | 0.00 | XXXX | 565 |
| ATOM | 566 | C   | ALA A | 89 | −11.406 | 54.060 | 38.039 | 1.00 | 0.00 | XXXX | 566 |
| ATOM | 567 | O   | ALA A | 89 | −10.868 | 53.259 | 37.274 | 1.00 | 0.00 | XXXX | 567 |
| ATOM | 568 | CB  | ALA A | 89 | −11.841 | 56.439 | 37.372 | 1.00 | 0.00 | XXXX | 568 |
| ATOM | 569 | N   | TRP A | 90 | −12.423 | 53.739 | 38.832 | 1.00 | 0.00 | XXXX | 569 |
| ATOM | 570 | CA  | TRP A | 90 | −13.065 | 52.431 | 38.784 | 1.00 | 0.00 | XXXX | 570 |
| ATOM | 571 | C   | TRP A | 90 | −14.567 | 52.602 | 38.973 | 1.00 | 0.00 | XXXX | 571 |
| ATOM | 572 | O   | TRP A | 90 | −15.344 | 52.381 | 38.045 | 1.00 | 0.00 | XXXX | 572 |
| ATOM | 573 | CB  | TRP A | 90 | −12.486 | 51.490 | 39.853 | 1.00 | 0.00 | XXXX | 573 |
| ATOM | 574 | CG  | TRP A | 90 | −13.174 | 50.143 | 39.939 | 1.00 | 0.00 | XXXX | 574 |
| ATOM | 575 | CD1 | TRP A | 90 | −14.453 | 49.894 | 40.354 | 1.00 | 0.00 | XXXX | 575 |
| ATOM | 576 | CD2 | TRP A | 90 | −12.612 | 48.866 | 39.600 | 1.00 | 0.00 | XXXX | 576 |
| ATOM | 577 | NE1 | TRP A | 90 | −14.720 | 48.549 | 40.291 | 1.00 | 0.00 | XXXX | 577 |
| ATOM | 578 | CE2 | TRP A | 90 | −13.608 | 47.895 | 39.834 | 1.00 | 0.00 | XXXX | 578 |
| ATOM | 579 | CE3 | TRP A | 90 | −11.364 | 48.450 | 39.124 | 1.00 | 0.00 | XXXX | 579 |
| ATOM | 580 | CZ2 | TRP A | 90 | −13.395 | 46.536 | 39.606 | 1.00 | 0.00 | XXXX | 580 |
| ATOM | 581 | CZ3 | TRP A | 90 | −11.155 | 47.100 | 38.897 | 1.00 | 0.00 | XXXX | 581 |
| ATOM | 582 | CH2 | TRP A | 90 | −12.165 | 46.159 | 39.139 | 1.00 | 0.00 | XXXX | 582 |
| ATOM | 583 | N   | THR A | 91 | −14.974 | 52.998 | 40.177 | 1.00 | 0.00 | XXXX | 583 |
| ATOM | 584 | CA  | THR A | 91 | −16.388 | 53.216 | 40.450 | 1.00 | 0.00 | XXXX | 584 |
| ATOM | 585 | C   | THR A | 91 | −16.904 | 54.349 | 39.574 | 1.00 | 0.00 | XXXX | 585 |
| ATOM | 586 | O   | THR A | 91 | −16.183 | 55.310 | 39.301 | 1.00 | 0.00 | XXXX | 586 |
| ATOM | 587 | CB  | THR A | 91 | −16.650 | 53.555 | 41.930 | 1.00 | 0.00 | XXXX | 587 |
| ATOM | 588 | OG1 | THR A | 91 | −16.068 | 54.825 | 42.246 | 1.00 | 0.00 | XXXX | 588 |
| ATOM | 589 | CG2 | THR A | 91 | −16.068 | 52.483 | 42.843 | 1.00 | 0.00 | XXXX | 589 |
| ATOM | 590 | N   | SER A | 92 | −18.156 | 54.240 | 39.145 | 1.00 | 0.00 | XXXX | 590 |
| ATOM | 591 | CA  | SER A | 92 | −18.775 | 55.281 | 38.339 | 1.00 | 0.00 | XXXX | 591 |
| ATOM | 592 | C   | SER A | 92 | −18.872 | 56.580 | 39.131 | 1.00 | 0.00 | XXXX | 592 |
| ATOM | 593 | O   | SER A | 92 | −18.956 | 57.665 | 38.556 | 1.00 | 0.00 | XXXX | 593 |
| ATOM | 594 | CB  | SER A | 92 | −20.158 | 54.838 | 37.862 | 1.00 | 0.00 | XXXX | 594 |
| ATOM | 595 | OG  | SER A | 92 | −20.052 | 53.751 | 36.960 | 1.00 | 0.00 | XXXX | 595 |

-continued

| ATOM | 596 | N | ALA A | 93 | −18.855 | 56.460 | 40.456 | 1.00 | 0.00 | XXXX | 596 |
| ATOM | 597 | CA | ALA A | 93 | −18.814 | 57.625 | 41.331 | 1.00 | 0.00 | XXXX | 597 |
| ATOM | 598 | C | ALA A | 93 | −17.519 | 58.400 | 41.124 | 1.00 | 0.00 | XXXX | 598 |
| ATOM | 599 | O | ALA A | 93 | −17.528 | 59.626 | 41.002 | 1.00 | 0.00 | XXXX | 599 |
| ATOM | 600 | CB | ALA A | 93 | −18.956 | 57.204 | 42.790 | 1.00 | 0.00 | XXXX | 600 |
| ATOM | 601 | N | SER A | 94 | −16.404 | 57.677 | 41.080 | 1.00 | 0.00 | XXXX | 601 |
| ATOM | 602 | CA | SER A | 94 | −15.100 | 58.295 | 40.870 | 1.00 | 0.00 | XXXX | 602 |
| ATOM | 603 | C | SER A | 94 | −14.969 | 58.852 | 39.453 | 1.00 | 0.00 | XXXX | 603 |
| ATOM | 604 | O | SER A | 94 | −14.401 | 59.926 | 39.254 | 1.00 | 0.00 | XXXX | 604 |
| ATOM | 605 | CB | SER A | 94 | −13.975 | 57.293 | 41.153 | 1.00 | 0.00 | XXXX | 605 |
| ATOM | 606 | OG | SER A | 94 | −13.952 | 56.252 | 40.193 | 1.00 | 0.00 | XXXX | 606 |
| ATOM | 607 | N | ARG A | 95 | −15.492 | 58.121 | 38.472 | 1.00 | 0.00 | XXXX | 607 |
| ATOM | 608 | CA | ARG A | 95 | −15.432 | 58.572 | 37.085 | 1.00 | 0.00 | XXXX | 608 |
| ATOM | 609 | C | ARG A | 95 | −16.239 | 59.853 | 36.901 | 1.00 | 0.00 | XXXX | 609 |
| ATOM | 610 | O | ARG A | 95 | −15.793 | 60.793 | 36.242 | 1.00 | 0.00 | XXXX | 610 |
| ATOM | 611 | CB | ARG A | 95 | −15.945 | 57.495 | 36.126 | 1.00 | 0.00 | XXXX | 611 |
| ATOM | 612 | CG | ARG A | 95 | −15.678 | 57.820 | 34.659 | 1.00 | 0.00 | XXXX | 612 |
| ATOM | 613 | CD | ARG A | 95 | −16.442 | 56.911 | 33.702 | 1.00 | 0.00 | XXXX | 613 |
| ATOM | 614 | NE | ARG A | 95 | −17.890 | 57.088 | 33.800 | 1.00 | 0.00 | XXXX | 614 |
| ATOM | 615 | CZ | ARG A | 95 | −18.702 | 56.256 | 34.442 | 1.00 | 0.00 | XXXX | 615 |
| ATOM | 616 | NH1 | ARG A | 95 | −18.213 | 55.180 | 35.040 | 1.00 | 0.00 | XXXX | 616 |
| ATOM | 617 | NH2 | ARG A | 95 | −20.006 | 56.498 | 34.480 | 1.00 | 0.00 | XXXX | 617 |
| ATOM | 618 | N | LYS A | 96 | −17.432 | 59.881 | 37.487 | 1.00 | 0.00 | XXXX | 618 |
| ATOM | 619 | CA | LYS A | 96 | −18.325 | 61.025 | 37.350 | 1.00 | 0.00 | XXXX | 619 |
| ATOM | 620 | C | LYS A | 96 | −17.824 | 62.235 | 38.130 | 1.00 | 0.00 | XXXX | 620 |
| ATOM | 621 | O | LYS A | 96 | −18.209 | 63.368 | 37.843 | 1.00 | 0.00 | XXXX | 621 |
| ATOM | 622 | CB | LYS A | 96 | −19.738 | 60.654 | 37.801 | 1.00 | 0.00 | XXXX | 622 |
| ATOM | 623 | CG | LYS A | 96 | −20.516 | 59.852 | 36.768 | 1.00 | 0.00 | XXXX | 623 |
| ATOM | 624 | CD | LYS A | 96 | −21.931 | 59.556 | 37.234 | 1.00 | 0.00 | XXXX | 624 |
| ATOM | 625 | CE | LYS A | 96 | −22.659 | 58.663 | 36.243 | 1.00 | 0.00 | XXXX | 625 |
| ATOM | 626 | NZ | LYS A | 96 | −22.860 | 59.339 | 34.929 | 1.00 | 0.00 | XXXX | 626 |
| ATOM | 627 | N | ALA A | 97 | −16.974 | 61.993 | 39.122 | 1.00 | 0.00 | XXXX | 627 |
| ATOM | 628 | CA | ALA A | 97 | −16.320 | 63.081 | 39.840 | 1.00 | 0.00 | XXXX | 628 |
| ATOM | 629 | C | ALA A | 97 | −15.213 | 63.679 | 38.977 | 1.00 | 0.00 | XXXX | 629 |
| ATOM | 630 | O | ALA A | 97 | −14.947 | 64.881 | 39.022 | 1.00 | 0.00 | XXXX | 630 |
| ATOM | 631 | CB | ALA A | 97 | −15.766 | 62.591 | 41.166 | 1.00 | 0.00 | XXXX | 631 |
| ATOM | 632 | N | VAL A | 98 | −14.571 | 62.821 | 38.191 | 1.00 | 0.00 | XXXX | 632 |
| ATOM | 633 | CA | VAL A | 98 | −13.494 | 63.233 | 37.300 | 1.00 | 0.00 | XXXX | 633 |
| ATOM | 634 | C | VAL A | 98 | −14.030 | 63.852 | 36.011 | 1.00 | 0.00 | XXXX | 634 |
| ATOM | 635 | O | VAL A | 98 | −13.383 | 64.713 | 35.412 | 1.00 | 0.00 | XXXX | 635 |
| ATOM | 636 | CB | VAL A | 98 | −12.584 | 62.040 | 36.944 | 1.00 | 0.00 | XXXX | 636 |
| ATOM | 637 | CG1 | VAL A | 98 | −11.600 | 62.422 | 35.846 | 1.00 | 0.00 | XXXX | 637 |
| ATOM | 638 | CG2 | VAL A | 98 | −11.851 | 61.541 | 38.185 | 1.00 | 0.00 | XXXX | 638 |
| ATOM | 639 | N | LEU A | 99 | −15.212 | 63.406 | 35.594 | 1.00 | 0.00 | XXXX | 639 |
| ATOM | 640 | CA | LEU A | 99 | −15.792 | 63.798 | 34.310 | 1.00 | 0.00 | XXXX | 640 |
| ATOM | 641 | C | LEU A | 99 | −15.823 | 65.314 | 34.091 | 1.00 | 0.00 | XXXX | 641 |
| ATOM | 642 | O | LEU A | 99 | −15.362 | 65.800 | 33.058 | 1.00 | 0.00 | XXXX | 642 |
| ATOM | 643 | CB | LEU A | 99 | −17.206 | 63.224 | 34.176 | 1.00 | 0.00 | XXXX | 643 |
| ATOM | 644 | CG | LEU A | 99 | −17.940 | 63.439 | 32.847 | 1.00 | 0.00 | XXXX | 644 |
| ATOM | 645 | CD1 | LEU A | 99 | −19.041 | 62.404 | 32.676 | 1.00 | 0.00 | XXXX | 645 |
| ATOM | 646 | CD2 | LEU A | 99 | −18.517 | 64.841 | 32.745 | 1.00 | 0.00 | XXXX | 646 |
| ATOM | 647 | N | PRO A | 100 | −16.370 | 66.068 | 35.056 | 1.00 | 0.00 | XXXX | 647 |
| ATOM | 648 | CA | PRO A | 100 | −16.426 | 67.525 | 34.888 | 1.00 | 0.00 | XXXX | 648 |
| ATOM | 649 | C | PRO A | 100 | −15.041 | 68.169 | 34.835 | 1.00 | 0.00 | XXXX | 649 |
| ATOM | 650 | O | PRO A | 100 | −14.880 | 69.217 | 34.208 | 1.00 | 0.00 | XXXX | 650 |
| ATOM | 651 | CB | PRO A | 100 | −17.203 | 67.994 | 36.125 | 1.00 | 0.00 | XXXX | 651 |
| ATOM | 652 | CG | PRO A | 100 | −17.051 | 66.889 | 37.116 | 1.00 | 0.00 | XXXX | 652 |
| ATOM | 653 | CD | PRO A | 100 | −17.002 | 65.632 | 36.311 | 1.00 | 0.00 | XXXX | 653 |
| ATOM | 654 | N | VAL A | 101 | −14.055 | 67.546 | 35.472 | 1.00 | 0.00 | XXXX | 654 |
| ATOM | 655 | CA | VAL A | 101 | −12.702 | 68.091 | 35.480 | 1.00 | 0.00 | XXXX | 655 |
| ATOM | 656 | C | VAL A | 101 | −12.028 | 67.972 | 34.113 | 1.00 | 0.00 | XXXX | 656 |
| ATOM | 657 | O | VAL A | 101 | −11.437 | 68.935 | 33.625 | 1.00 | 0.00 | XXXX | 657 |
| ATOM | 658 | CB | VAL A | 101 | −11.818 | 67.397 | 36.533 | 1.00 | 0.00 | XXXX | 658 |
| ATOM | 659 | CG1 | VAL A | 101 | −10.416 | 67.991 | 36.518 | 1.00 | 0.00 | XXXX | 659 |
| ATOM | 660 | CG2 | VAL A | 101 | −12.442 | 67.519 | 37.916 | 1.00 | 0.00 | XXXX | 660 |
| ATOM | 661 | N | VAL A | 102 | −12.117 | 66.798 | 33.494 | 1.00 | 0.00 | XXXX | 661 |
| ATOM | 662 | CA | VAL A | 102 | −11.510 | 66.597 | 32.181 | 1.00 | 0.00 | XXXX | 662 |
| ATOM | 663 | C | VAL A | 102 | −12.256 | 67.371 | 31.098 | 1.00 | 0.00 | XXXX | 663 |
| ATOM | 664 | O | VAL A | 102 | −11.656 | 67.824 | 30.123 | 1.00 | 0.00 | XXXX | 664 |
| ATOM | 665 | CB | VAL A | 102 | −11.460 | 65.103 | 31.790 | 1.00 | 0.00 | XXXX | 665 |
| ATOM | 666 | CG1 | VAL A | 102 | −10.355 | 64.385 | 32.555 | 1.00 | 0.00 | XXXX | 666 |
| ATOM | 667 | CG2 | VAL A | 102 | −12.816 | 64.441 | 32.014 | 1.00 | 0.00 | XXXX | 667 |
| ATOM | 668 | N | GLU A | 103 | −13.565 | 67.524 | 31.268 | 1.00 | 0.00 | XXXX | 668 |
| ATOM | 669 | CA | GLU A | 103 | −14.356 | 68.281 | 30.308 | 1.00 | 0.00 | XXXX | 669 |
| ATOM | 670 | C | GLU A | 103 | −14.040 | 69.775 | 30.387 | 1.00 | 0.00 | XXXX | 670 |
| ATOM | 671 | O | GLU A | 103 | −13.872 | 70.432 | 29.364 | 1.00 | 0.00 | XXXX | 671 |
| ATOM | 672 | CB | GLU A | 103 | −15.851 | 68.037 | 30.525 | 1.00 | 0.00 | XXXX | 672 |
| ATOM | 673 | CG | GLU A | 103 | −16.314 | 66.655 | 30.082 | 1.00 | 0.00 | XXXX | 673 |
| ATOM | 674 | CD | GLU A | 103 | −17.819 | 66.556 | 29.929 | 1.00 | 0.00 | XXXX | 674 |

| | | | | | | | | | | |
|---|---|---|---|---|---|---|---|---|---|---|
| ATOM | 675 | OE1 | GLU A | 103 | −18.519 | 67.542 | 30.246 | 1.00 | 0.00 | XXXX | 675 |
| ATOM | 676 | OE2 | GLU A | 103 | −18.304 | 65.493 | 29.486 | 1.00 | 0.00 | XXXX | 676 |
| ATOM | 677 | N | GLU A | 104 | −13.952 | 70.313 | 31.598 | 1.00 | 0.00 | XXXX | 677 |
| ATOM | 678 | CA | GLU A | 104 | −13.697 | 71.742 | 31.760 | 1.00 | 0.00 | XXXX | 678 |
| ATOM | 679 | C | GLU A | 104 | −12.282 | 72.114 | 31.314 | 1.00 | 0.00 | XXXX | 679 |
| ATOM | 680 | O | GLU A | 104 | −12.057 | 73.201 | 30.782 | 1.00 | 0.00 | XXXX | 680 |
| ATOM | 681 | CB | GLU A | 104 | −13.932 | 72.173 | 33.208 | 1.00 | 0.00 | XXXX | 681 |
| ATOM | 682 | CG | GLU A | 104 | −14.016 | 73.681 | 33.384 | 1.00 | 0.00 | XXXX | 682 |
| ATOM | 683 | CD | GLU A | 104 | −14.200 | 74.096 | 34.829 | 1.00 | 0.00 | XXXX | 683 |
| ATOM | 684 | OE1 | GLU A | 104 | −13.909 | 73.278 | 35.726 | 1.00 | 0.00 | XXXX | 684 |
| ATOM | 685 | OE2 | GLU A | 104 | −14.639 | 75.241 | 35.068 | 1.00 | 0.00 | XXXX | 685 |
| ATOM | 686 | N | ASN A | 105 | −11.332 | 71.211 | 31.536 | 1.00 | 0.00 | XXXX | 686 |
| ATOM | 687 | CA | ASN A | 105 | −9.946 | 71.456 | 31.151 | 1.00 | 0.00 | XXXX | 687 |
| ATOM | 688 | C | ASN A | 105 | −9.622 | 70.888 | 29.774 | 1.00 | 0.00 | XXXX | 688 |
| ATOM | 689 | O | ASN A | 105 | −8.492 | 71.002 | 29.298 | 1.00 | 0.00 | XXXX | 689 |
| ATOM | 690 | CB | ASN A | 105 | −8.990 | 70.861 | 32.187 | 1.00 | 0.00 | XXXX | 690 |
| ATOM | 691 | CG | ASN A | 105 | −9.072 | 71.563 | 33.527 | 1.00 | 0.00 | XXXX | 691 |
| ATOM | 692 | OD1 | ASN A | 105 | −8.410 | 72.576 | 33.750 | 1.00 | 0.00 | XXXX | 692 |
| ATOM | 693 | ND2 | ASN A | 105 | −9.882 | 71.023 | 34.430 | 1.00 | 0.00 | XXXX | 693 |
| ATOM | 694 | N | ASN A | 106 | −10.626 | 70.293 | 29.136 | 1.00 | 0.00 | XXXX | 694 |
| ATOM | 695 | CA | ASN A | 106 | −10.432 | 69.558 | 27.890 | 1.00 | 0.00 | XXXX | 695 |
| ATOM | 696 | C | ASN A | 106 | −9.271 | 68.570 | 27.988 | 1.00 | 0.00 | XXXX | 696 |
| ATOM | 697 | O | ASN A | 106 | −8.399 | 68.527 | 27.121 | 1.00 | 0.00 | XXXX | 697 |
| ATOM | 698 | CB | ASN A | 106 | −10.202 | 70.524 | 26.726 | 1.00 | 0.00 | XXXX | 698 |
| ATOM | 699 | CG | ASN A | 106 | −10.392 | 69.862 | 25.371 | 1.00 | 0.00 | XXXX | 699 |
| ATOM | 700 | OD1 | ASN A | 106 | −11.155 | 68.904 | 25.236 | 1.00 | 0.00 | XXXX | 700 |
| ATOM | 701 | ND2 | ASN A | 106 | −9.698 | 70.373 | 24.360 | 1.00 | 0.00 | XXXX | 701 |
| ATOM | 702 | N | GLY A | 107 | −9.263 | 67.786 | 29.059 | 1.00 | 0.00 | XXXX | 702 |
| ATOM | 703 | CA | GLY A | 107 | −8.279 | 66.734 | 29.219 | 1.00 | 0.00 | XXXX | 703 |
| ATOM | 704 | C | GLY A | 107 | −8.853 | 65.413 | 28.755 | 1.00 | 0.00 | XXXX | 704 |
| ATOM | 705 | O | GLY A | 107 | −9.961 | 65.362 | 28.222 | 1.00 | 0.00 | XXXX | 705 |
| ATOM | 706 | N | LEU A | 108 | −8.102 | 64.337 | 28.958 | 1.00 | 0.00 | XXXX | 706 |
| ATOM | 707 | CA | LEU A | 108 | −8.586 | 63.011 | 28.606 | 1.00 | 0.00 | XXXX | 707 |
| ATOM | 708 | C | LEU A | 108 | −8.441 | 62.034 | 29.762 | 1.00 | 0.00 | XXXX | 708 |
| ATOM | 709 | O | LEU A | 108 | −7.395 | 61.964 | 30.406 | 1.00 | 0.00 | XXXX | 709 |
| ATOM | 710 | CB | LEU A | 108 | −7.845 | 62.477 | 27.380 | 1.00 | 0.00 | XXXX | 710 |
| ATOM | 711 | CG | LEU A | 108 | −8.200 | 63.120 | 26.038 | 1.00 | 0.00 | XXXX | 711 |
| ATOM | 712 | CD1 | LEU A | 108 | −7.440 | 62.440 | 24.908 | 1.00 | 0.00 | XXXX | 712 |
| ATOM | 713 | CD2 | LEU A | 108 | −9.705 | 63.067 | 25.796 | 1.00 | 0.00 | XXXX | 713 |
| ATOM | 714 | N | LEU A | 109 | −9.507 | 61.284 | 30.021 | 1.00 | 0.00 | XXXX | 714 |
| ATOM | 715 | CA | LEU A | 109 | −9.450 | 60.171 | 30.953 | 1.00 | 0.00 | XXXX | 715 |
| ATOM | 716 | C | LEU A | 109 | −9.620 | 58.862 | 30.200 | 1.00 | 0.00 | XXXX | 716 |
| ATOM | 717 | O | LEU A | 109 | −10.591 | 58.687 | 29.462 | 1.00 | 0.00 | XXXX | 717 |
| ATOM | 718 | CB | LEU A | 109 | −10.530 | 60.294 | 32.031 | 1.00 | 0.00 | XXXX | 718 |
| ATOM | 719 | CG | LEU A | 109 | −10.652 | 59.069 | 32.943 | 1.00 | 0.00 | XXXX | 719 |
| ATOM | 720 | CD1 | LEU A | 109 | −9.465 | 58.982 | 33.895 | 1.00 | 0.00 | XXXX | 720 |
| ATOM | 721 | CD2 | LEU A | 109 | −11.964 | 59.072 | 33.712 | 1.00 | 0.00 | XXXX | 721 |
| ATOM | 722 | N | PHE A | 110 | −8.676 | 57.947 | 30.378 | 1.00 | 0.00 | XXXX | 722 |
| ATOM | 723 | CA | PHE A | 110 | −8.857 | 56.595 | 29.874 | 1.00 | 0.00 | XXXX | 723 |
| ATOM | 724 | C | PHE A | 110 | −9.316 | 55.706 | 31.024 | 1.00 | 0.00 | XXXX | 724 |
| ATOM | 725 | O | PHE A | 110 | −8.565 | 55.422 | 31.957 | 1.00 | 0.00 | XXXX | 725 |
| ATOM | 726 | CB | PHE A | 110 | −7.575 | 56.072 | 29.222 | 1.00 | 0.00 | XXXX | 726 |
| ATOM | 727 | CG | PHE A | 110 | −7.461 | 56.424 | 27.762 | 1.00 | 0.00 | XXXX | 727 |
| ATOM | 728 | CD1 | PHE A | 110 | −7.281 | 57.739 | 27.365 | 1.00 | 0.00 | XXXX | 728 |
| ATOM | 729 | CD2 | PHE A | 110 | −7.558 | 55.444 | 26.788 | 1.00 | 0.00 | XXXX | 729 |
| ATOM | 730 | CE1 | PHE A | 110 | −7.189 | 58.069 | 26.023 | 1.00 | 0.00 | XXXX | 730 |
| ATOM | 731 | CE2 | PHE A | 110 | −7.465 | 55.767 | 25.444 | 1.00 | 0.00 | XXXX | 731 |
| ATOM | 732 | CZ | PHE A | 110 | −7.279 | 57.081 | 25.063 | 1.00 | 0.00 | XXXX | 732 |
| ATOM | 733 | N | TYR A | 111 | −10.573 | 55.285 | 30.929 | 1.00 | 0.00 | XXXX | 733 |
| ATOM | 734 | CA | TYR A | 111 | −11.288 | 54.600 | 31.999 | 1.00 | 0.00 | XXXX | 734 |
| ATOM | 735 | C | TYR A | 111 | −11.451 | 53.115 | 31.675 | 1.00 | 0.00 | XXXX | 735 |
| ATOM | 736 | O | TYR A | 111 | −12.111 | 52.760 | 30.702 | 1.00 | 0.00 | XXXX | 736 |
| ATOM | 737 | CB | TYR A | 111 | −12.644 | 55.283 | 32.196 | 1.00 | 0.00 | XXXX | 737 |
| ATOM | 738 | CG | TYR A | 111 | −13.602 | 54.604 | 33.139 | 1.00 | 0.00 | XXXX | 738 |
| ATOM | 739 | CD1 | TYR A | 111 | −14.751 | 53.994 | 32.658 | 1.00 | 0.00 | XXXX | 739 |
| ATOM | 740 | CD2 | TYR A | 111 | −13.372 | 54.588 | 34.506 | 1.00 | 0.00 | XXXX | 740 |
| ATOM | 741 | CE1 | TYR A | 111 | −15.640 | 53.380 | 33.509 | 1.00 | 0.00 | XXXX | 741 |
| ATOM | 742 | CE2 | TYR A | 111 | −14.259 | 53.974 | 35.369 | 1.00 | 0.00 | XXXX | 742 |
| ATOM | 743 | CZ | TYR A | 111 | −15.393 | 53.370 | 34.861 | 1.00 | 0.00 | XXXX | 743 |
| ATOM | 744 | OH | TYR A | 111 | −16.286 | 52.753 | 35.705 | 1.00 | 0.00 | XXXX | 744 |
| ATOM | 745 | N | PRO A | 112 | −10.838 | 52.243 | 32.491 | 1.00 | 0.00 | XXXX | 745 |
| ATOM | 746 | CA | PRO A | 112 | −10.720 | 50.820 | 32.157 | 1.00 | 0.00 | XXXX | 746 |
| ATOM | 747 | C | PRO A | 112 | −11.776 | 49.881 | 32.746 | 1.00 | 0.00 | XXXX | 747 |
| ATOM | 748 | O | PRO A | 112 | −11.618 | 48.670 | 32.601 | 1.00 | 0.00 | XXXX | 748 |
| ATOM | 749 | CB | PRO A | 112 | −9.349 | 50.464 | 32.732 | 1.00 | 0.00 | XXXX | 749 |
| ATOM | 750 | CG | PRO A | 112 | −9.266 | 51.308 | 33.965 | 1.00 | 0.00 | XXXX | 750 |
| ATOM | 751 | CD | PRO A | 112 | −10.003 | 52.599 | 33.653 | 1.00 | 0.00 | XXXX | 751 |
| ATOM | 752 | N | VAL A | 113 | −12.824 | 50.397 | 33.379 | 1.00 | 0.00 | XXXX | 752 |
| ATOM | 753 | CA | VAL A | 113 | −13.725 | 49.515 | 34.122 | 1.00 | 0.00 | XXXX | 753 |

-continued

| | | | | | | | | | | |
|---|---|---|---|---|---|---|---|---|---|---|
| ATOM | 754 | C | VAL A | 113 | −15.135 | 49.412 | 33.538 | 1.00 | 0.00 XXXX | 754 |
| ATOM | 755 | O | VAL A | 113 | −15.710 | 50.399 | 33.081 | 1.00 | 0.00 XXXX | 755 |
| ATOM | 756 | CB | VAL A | 113 | −13.846 | 49.960 | 35.597 | 1.00 | 0.00 XXXX | 756 |
| ATOM | 757 | CG1 | VAL A | 113 | −14.743 | 49.002 | 36.370 | 1.00 | 0.00 XXXX | 757 |
| ATOM | 758 | CG2 | VAL A | 113 | −12.469 | 50.039 | 36.243 | 1.00 | 0.00 XXXX | 758 |
| ATOM | 759 | N | GLN A | 114 | −15.672 | 48.195 | 33.548 | 1.00 | 0.00 XXXX | 759 |
| ATOM | 760 | CA | GLN A | 114 | −17.074 | 47.943 | 33.221 | 1.00 | 0.00 XXXX | 760 |
| ATOM | 761 | C | GLN A | 114 | −17.998 | 48.907 | 33.966 | 1.00 | 0.00 XXXX | 761 |
| ATOM | 762 | O | GLN A | 114 | −17.713 | 49.289 | 35.101 | 1.00 | 0.00 XXXX | 762 |
| ATOM | 763 | CB | GLN A | 114 | −17.440 | 46.493 | 33.554 | 1.00 | 0.00 XXXX | 763 |
| ATOM | 764 | CG | GLN A | 114 | −17.139 | 46.081 | 34.996 | 1.00 | 0.00 XXXX | 764 |
| ATOM | 765 | CD | GLN A | 114 | −18.215 | 46.511 | 35.979 | 1.00 | 0.00 XXXX | 765 |
| ATOM | 766 | OE1 | GLN A | 114 | −17.920 | 46.887 | 37.115 | 1.00 | 0.00 XXXX | 766 |
| ATOM | 767 | NE2 | GLN A | 114 | −19.469 | 46.444 | 35.551 | 1.00 | 0.00 XXXX | 767 |
| ATOM | 768 | N | TYR A | 115 | −19.101 | 49.303 | 33.338 | 1.00 | 0.00 XXXX | 768 |
| ATOM | 769 | CA | TYR A | 115 | −20.004 | 50.247 | 33.987 | 1.00 | 0.00 XXXX | 769 |
| ATOM | 770 | C | TYR A | 115 | −21.408 | 50.254 | 33.378 | 1.00 | 0.00 XXXX | 770 |
| ATOM | 771 | O | TYR A | 115 | −21.729 | 49.447 | 32.502 | 1.00 | 0.00 XXXX | 771 |
| ATOM | 772 | CB | TYR A | 115 | −19.392 | 51.657 | 33.960 | 1.00 | 0.00 XXXX | 772 |
| ATOM | 773 | CG | TYR A | 115 | −19.652 | 52.454 | 32.699 | 1.00 | 0.00 XXXX | 773 |
| ATOM | 774 | CD1 | TYR A | 115 | −19.157 | 52.037 | 31.470 | 1.00 | 0.00 XXXX | 774 |
| ATOM | 775 | CD2 | TYR A | 115 | −20.375 | 53.638 | 32.745 | 1.00 | 0.00 XXXX | 775 |
| ATOM | 776 | CE1 | TYR A | 115 | −19.394 | 52.770 | 30.317 | 1.00 | 0.00 XXXX | 776 |
| ATOM | 777 | CE2 | TYR A | 115 | −20.614 | 54.377 | 31.602 | 1.00 | 0.00 XXXX | 777 |
| ATOM | 778 | CZ | TYR A | 115 | −20.125 | 53.941 | 30.392 | 1.00 | 0.00 XXXX | 778 |
| ATOM | 779 | OH | TYR A | 115 | −20.367 | 54.684 | 29.257 | 1.00 | 0.00 XXXX | 779 |
| ATOM | 780 | N | GLU A | 116 | −22.241 | 51.170 | 33.863 | 1.00 | 0.00 XXXX | 780 |
| ATOM | 781 | CA | GLU A | 116 | −23.673 | 51.161 | 33.576 | 1.00 | 0.00 XXXX | 781 |
| ATOM | 782 | C | GLU A | 116 | −24.041 | 51.761 | 32.221 | 1.00 | 0.00 XXXX | 782 |
| ATOM | 783 | O | GLU A | 116 | −25.173 | 51.613 | 31.762 | 1.00 | 0.00 XXXX | 783 |
| ATOM | 784 | CB | GLU A | 116 | −24.424 | 51.910 | 34.681 | 1.00 | 0.00 XXXX | 784 |
| ATOM | 785 | CG | GLU A | 116 | −24.204 | 53.420 | 34.681 | 1.00 | 0.00 XXXX | 785 |
| ATOM | 786 | CD | GLU A | 116 | −22.870 | 53.832 | 35.282 | 1.00 | 0.00 XXXX | 786 |
| ATOM | 787 | OE1 | GLU A | 116 | −22.158 | 52.962 | 35.831 | 1.00 | 0.00 XXXX | 787 |
| ATOM | 788 | OE2 | GLU A | 116 | −22.536 | 55.034 | 35.214 | 1.00 | 0.00 XXXX | 788 |
| ATOM | 789 | N | GLY A | 117 | −23.093 | 52.438 | 31.584 | 1.00 | 0.00 XXXX | 789 |
| ATOM | 790 | CA | GLY A | 117 | −23.380 | 53.130 | 30.341 | 1.00 | 0.00 XXXX | 790 |
| ATOM | 791 | C | GLY A | 117 | −24.174 | 54.403 | 30.578 | 1.00 | 0.00 XXXX | 791 |
| ATOM | 792 | O | GLY A | 117 | −23.981 | 55.079 | 31.589 | 1.00 | 0.00 XXXX | 792 |
| ATOM | 793 | N | LEU A | 118 | −25.069 | 54.728 | 29.648 | 1.00 | 0.00 XXXX | 793 |
| ATOM | 794 | CA | LEU A | 118 | −25.884 | 55.937 | 29.751 | 1.00 | 0.00 XXXX | 794 |
| ATOM | 795 | C | LEU A | 118 | −25.006 | 57.178 | 29.882 | 1.00 | 0.00 XXXX | 795 |
| ATOM | 796 | O | LEU A | 118 | −25.378 | 58.155 | 30.532 | 1.00 | 0.00 XXXX | 796 |
| ATOM | 797 | CB | LEU A | 118 | −26.848 | 55.838 | 30.934 | 1.00 | 0.00 XXXX | 797 |
| ATOM | 798 | CG | LEU A | 118 | −27.837 | 54.674 | 30.876 | 1.00 | 0.00 XXXX | 798 |
| ATOM | 799 | CD1 | LEU A | 118 | −28.815 | 54.738 | 32.035 | 1.00 | 0.00 XXXX | 799 |
| ATOM | 800 | CD2 | LEU A | 118 | −28.578 | 54.672 | 29.547 | 1.00 | 0.00 XXXX | 800 |
| ATOM | 801 | N | GLU A | 119 | −23.837 | 57.122 | 29.254 | 1.00 | 0.00 XXXX | 801 |
| ATOM | 802 | CA | GLU A | 119 | −22.868 | 58.207 | 29.315 | 1.00 | 0.00 XXXX | 802 |
| ATOM | 803 | C | GLU A | 119 | −21.970 | 58.175 | 28.084 | 1.00 | 0.00 XXXX | 803 |
| ATOM | 804 | O | GLU A | 119 | −21.747 | 57.115 | 27.501 | 1.00 | 0.00 XXXX | 804 |
| ATOM | 805 | CB | GLU A | 119 | −22.032 | 58.102 | 30.592 | 1.00 | 0.00 XXXX | 805 |
| ATOM | 806 | CG | GLU A | 119 | −21.065 | 59.252 | 30.813 | 1.00 | 0.00 XXXX | 806 |
| ATOM | 807 | CD | GLU A | 119 | −20.138 | 59.005 | 31.989 | 1.00 | 0.00 XXXX | 807 |
| ATOM | 808 | OE1 | GLU A | 119 | −20.617 | 59.049 | 33.143 | 1.00 | 0.00 XXXX | 808 |
| ATOM | 809 | OE2 | GLU A | 119 | −18.933 | 58.761 | 31.761 | 1.00 | 0.00 XXXX | 809 |
| ATOM | 810 | N | SER A | 120 | −21.465 | 59.338 | 27.686 | 1.00 | 0.00 XXXX | 810 |
| ATOM | 811 | CA | SER A | 120 | −20.501 | 59.414 | 26.593 | 1.00 | 0.00 XXXX | 811 |
| ATOM | 812 | C | SER A | 120 | −19.807 | 60.770 | 26.561 | 1.00 | 0.00 XXXX | 812 |
| ATOM | 813 | O | SER A | 120 | −20.096 | 61.607 | 25.705 | 1.00 | 0.00 XXXX | 813 |
| ATOM | 814 | CB | SER A | 120 | −21.181 | 59.142 | 25.250 | 1.00 | 0.00 XXXX | 814 |
| ATOM | 815 | OG | SER A | 120 | −21.364 | 57.751 | 25.041 | 1.00 | 0.00 XXXX | 815 |
| ATOM | 816 | N | SER A | 121 | −18.890 | 60.981 | 27.498 | 1.00 | 0.00 XXXX | 816 |
| ATOM | 817 | CA | SER A | 121 | −18.124 | 62.218 | 27.552 | 1.00 | 0.00 XXXX | 817 |
| ATOM | 818 | C | SER A | 121 | −17.110 | 62.267 | 26.417 | 1.00 | 0.00 XXXX | 818 |
| ATOM | 819 | O | SER A | 121 | −16.403 | 61.292 | 26.171 | 1.00 | 0.00 XXXX | 819 |
| ATOM | 820 | CB | SER A | 121 | −17.412 | 62.353 | 28.900 | 1.00 | 0.00 XXXX | 820 |
| ATOM | 821 | OG | SER A | 121 | −16.499 | 63.439 | 28.891 | 1.00 | 0.00 XXXX | 821 |
| ATOM | 822 | N | PRO A | 122 | −17.035 | 63.409 | 25.718 | 1.00 | 0.00 XXXX | 822 |
| ATOM | 823 | CA | PRO A | 122 | −16.027 | 63.577 | 24.667 | 1.00 | 0.00 XXXX | 823 |
| ATOM | 824 | C | PRO A | 122 | −14.613 | 63.568 | 25.239 | 1.00 | 0.00 XXXX | 824 |
| ATOM | 825 | O | PRO A | 122 | −13.642 | 63.455 | 24.491 | 1.00 | 0.00 XXXX | 825 |
| ATOM | 826 | CB | PRO A | 122 | −16.371 | 64.944 | 24.068 | 1.00 | 0.00 XXXX | 826 |
| ATOM | 827 | CG | PRO A | 122 | −17.057 | 65.672 | 25.176 | 1.00 | 0.00 XXXX | 827 |
| ATOM | 828 | CD | PRO A | 122 | −17.848 | 64.623 | 25.905 | 1.00 | 0.00 XXXX | 828 |
| ATOM | 829 | N | ASN A | 123 | −14.508 | 63.675 | 26.561 | 1.00 | 0.00 XXXX | 829 |
| ATOM | 830 | CA | ASN A | 123 | −13.212 | 63.716 | 27.226 | 1.00 | 0.00 XXXX | 830 |
| ATOM | 831 | C | ASN A | 123 | −12.903 | 62.437 | 27.998 | 1.00 | 0.00 XXXX | 831 |
| ATOM | 832 | O | ASN A | 123 | −12.010 | 62.414 | 28.844 | 1.00 | 0.00 XXXX | 832 |

-continued

| | | | | | | | | | | |
|---|---|---|---|---|---|---|---|---|---|---|
| ATOM | 833 | CB | ASN A | 123 | −13.143 | 64.923 | 28.162 | 1.00 | 0.00 | XXXX | 833 |
| ATOM | 834 | CG | ASN A | 123 | −13.232 | 66.238 | 27.416 | 1.00 | 0.00 | XXXX | 834 |
| ATOM | 835 | OD1 | ASN A | 123 | −14.314 | 66.801 | 27.254 | 1.00 | 0.00 | XXXX | 835 |
| ATOM | 836 | ND2 | ASN A | 123 | −12.092 | 66.728 | 26.944 | 1.00 | 0.00 | XXXX | 836 |
| ATOM | 837 | N | ILE A | 124 | −13.649 | 61.377 | 27.708 | 1.00 | 0.00 | XXXX | 837 |
| ATOM | 838 | CA | ILE A | 124 | −13.376 | 60.073 | 28.299 | 1.00 | 0.00 | XXXX | 838 |
| ATOM | 839 | C | ILE A | 124 | −13.328 | 58.987 | 27.234 | 1.00 | 0.00 | XXXX | 839 |
| ATOM | 840 | O | ILE A | 124 | −14.194 | 58.921 | 26.361 | 1.00 | 0.00 | XXXX | 840 |
| ATOM | 841 | CB | ILE A | 124 | −14.434 | 59.681 | 29.351 | 1.00 | 0.00 | XXXX | 841 |
| ATOM | 842 | CG1 | ILE A | 124 | −14.496 | 60.717 | 30.474 | 1.00 | 0.00 | XXXX | 842 |
| ATOM | 843 | CG2 | ILE A | 124 | −14.127 | 58.303 | 29.928 | 1.00 | 0.00 | XXXX | 843 |
| ATOM | 844 | CD1 | ILE A | 124 | −15.513 | 60.382 | 31.545 | 1.00 | 0.00 | XXXX | 844 |
| ATOM | 845 | N | PHE A | 125 | −12.311 | 58.137 | 27.309 | 1.00 | 0.00 | XXXX | 845 |
| ATOM | 846 | CA | PHE A | 125 | −12.273 | 56.931 | 26.496 | 1.00 | 0.00 | XXXX | 846 |
| ATOM | 847 | C | PHE A | 125 | −12.527 | 55.719 | 27.387 | 1.00 | 0.00 | XXXX | 847 |
| ATOM | 848 | O | PHE A | 125 | −11.841 | 55.516 | 28.390 | 1.00 | 0.00 | XXXX | 848 |
| ATOM | 849 | CB | PHE A | 125 | −10.936 | 56.811 | 25.760 | 1.00 | 0.00 | XXXX | 849 |
| ATOM | 850 | CG | PHE A | 125 | −10.840 | 57.687 | 24.542 | 1.00 | 0.00 | XXXX | 850 |
| ATOM | 851 | CD1 | PHE A | 125 | −10.424 | 59.003 | 24.650 | 1.00 | 0.00 | XXXX | 851 |
| ATOM | 852 | CD2 | PHE A | 125 | −11.180 | 57.197 | 23.292 | 1.00 | 0.00 | XXXX | 852 |
| ATOM | 853 | CE1 | PHE A | 125 | −10.343 | 59.814 | 23.532 | 1.00 | 0.00 | XXXX | 853 |
| ATOM | 854 | CE2 | PHE A | 125 | −11.100 | 58.002 | 22.170 | 1.00 | 0.00 | XXXX | 854 |
| ATOM | 855 | CZ | PHE A | 125 | −10.679 | 59.311 | 22.289 | 1.00 | 0.00 | XXXX | 855 |
| ATOM | 856 | N | TYR A | 126 | −13.517 | 54.919 | 27.009 | 1.00 | 0.00 | XXXX | 856 |
| ATOM | 857 | CA | TYR A | 126 | −14.014 | 53.844 | 27.859 | 1.00 | 0.00 | XXXX | 857 |
| ATOM | 858 | C | TYR A | 126 | −13.481 | 52.493 | 27.398 | 1.00 | 0.00 | XXXX | 858 |
| ATOM | 859 | O | TYR A | 126 | −13.900 | 51.973 | 26.364 | 1.00 | 0.00 | XXXX | 859 |
| ATOM | 860 | CB | TYR A | 126 | −15.546 | 53.826 | 27.857 | 1.00 | 0.00 | XXXX | 860 |
| ATOM | 861 | CG | TYR A | 126 | −16.194 | 55.142 | 28.238 | 1.00 | 0.00 | XXXX | 861 |
| ATOM | 862 | CD1 | TYR A | 126 | −16.226 | 56.208 | 27.346 | 1.00 | 0.00 | XXXX | 862 |
| ATOM | 863 | CD2 | TYR A | 126 | −16.791 | 55.313 | 29.481 | 1.00 | 0.00 | XXXX | 863 |
| ATOM | 864 | CE1 | TYR A | 126 | −16.824 | 57.410 | 27.685 | 1.00 | 0.00 | XXXX | 864 |
| ATOM | 865 | CE2 | TYR A | 126 | −17.393 | 56.512 | 29.829 | 1.00 | 0.00 | XXXX | 865 |
| ATOM | 866 | CZ | TYR A | 126 | −17.406 | 57.557 | 28.927 | 1.00 | 0.00 | XXXX | 866 |
| ATOM | 867 | OH | TYR A | 126 | −18.003 | 58.750 | 29.271 | 1.00 | 0.00 | XXXX | 867 |
| ATOM | 868 | N | MET A | 127 | −12.555 | 51.929 | 28.167 | 1.00 | 0.00 | XXXX | 868 |
| ATOM | 869 | CA | MET A | 127 | −11.930 | 50.663 | 27.806 | 1.00 | 0.00 | XXXX | 869 |
| ATOM | 870 | C | MET A | 127 | −12.671 | 49.480 | 28.419 | 1.00 | 0.00 | XXXX | 870 |
| ATOM | 871 | O | MET A | 127 | −12.481 | 48.337 | 28.005 | 1.00 | 0.00 | XXXX | 871 |
| ATOM | 872 | CB | MET A | 127 | −10.464 | 50.648 | 28.247 | 1.00 | 0.00 | XXXX | 872 |
| ATOM | 873 | CG | MET A | 127 | −9.625 | 51.791 | 27.686 | 1.00 | 0.00 | XXXX | 873 |
| ATOM | 874 | SD | MET A | 127 | −9.443 | 51.750 | 25.889 | 1.00 | 0.00 | XXXX | 874 |
| ATOM | 875 | CE | MET A | 127 | −10.621 | 53.005 | 25.393 | 1.00 | 0.00 | XXXX | 875 |
| ATOM | 876 | N | GLY A | 128 | −13.514 | 49.760 | 29.408 | 1.00 | 0.00 | XXXX | 876 |
| ATOM | 877 | CA | GLY A | 128 | −14.316 | 48.729 | 30.039 | 1.00 | 0.00 | XXXX | 877 |
| ATOM | 878 | C | GLY A | 128 | −15.642 | 48.537 | 29.330 | 1.00 | 0.00 | XXXX | 878 |
| ATOM | 879 | O | GLY A | 128 | −16.068 | 49.390 | 28.551 | 1.00 | 0.00 | XXXX | 879 |
| ATOM | 880 | N | ALA A | 129 | −16.295 | 47.413 | 29.601 | 1.00 | 0.00 | XXXX | 880 |
| ATOM | 881 | CA | ALA A | 129 | −17.534 | 47.059 | 28.919 | 1.00 | 0.00 | XXXX | 881 |
| ATOM | 882 | C | ALA A | 129 | −18.643 | 48.087 | 29.123 | 1.00 | 0.00 | XXXX | 882 |
| ATOM | 883 | O | ALA A | 129 | −18.834 | 48.605 | 30.224 | 1.00 | 0.00 | XXXX | 883 |
| ATOM | 884 | CB | ALA A | 129 | −18.010 | 45.690 | 29.381 | 1.00 | 0.00 | XXXX | 884 |
| ATOM | 885 | N | ALA A | 130 | −19.367 | 48.375 | 28.047 | 1.00 | 0.00 | XXXX | 885 |
| ATOM | 886 | CA | ALA A | 130 | −20.666 | 49.022 | 28.151 | 1.00 | 0.00 | XXXX | 886 |
| ATOM | 887 | C | ALA A | 130 | −21.685 | 47.949 | 28.517 | 1.00 | 0.00 | XXXX | 887 |
| ATOM | 888 | O | ALA A | 130 | −21.403 | 46.758 | 28.383 | 1.00 | 0.00 | XXXX | 888 |
| ATOM | 889 | CB | ALA A | 130 | −21.038 | 49.716 | 26.851 | 1.00 | 0.00 | XXXX | 889 |
| ATOM | 890 | N | PRO A | 131 | −22.873 | 48.360 | 28.983 | 1.00 | 0.00 | XXXX | 890 |
| ATOM | 891 | CA | PRO A | 131 | −23.846 | 47.388 | 29.499 | 1.00 | 0.00 | XXXX | 891 |
| ATOM | 892 | C | PRO A | 131 | −24.266 | 46.325 | 28.478 | 1.00 | 0.00 | XXXX | 892 |
| ATOM | 893 | O | PRO A | 131 | −24.526 | 45.185 | 28.865 | 1.00 | 0.00 | XXXX | 893 |
| ATOM | 894 | CB | PRO A | 131 | −25.042 | 48.266 | 29.897 | 1.00 | 0.00 | XXXX | 894 |
| ATOM | 895 | CG | PRO A | 131 | −24.855 | 49.551 | 29.145 | 1.00 | 0.00 | XXXX | 895 |
| ATOM | 896 | CD | PRO A | 131 | −23.377 | 49.742 | 29.045 | 1.00 | 0.00 | XXXX | 896 |
| ATOM | 897 | N | ASN A | 132 | −24.316 | 46.680 | 27.197 | 1.00 | 0.00 | XXXX | 897 |
| ATOM | 898 | CA | ASN A | 132 | −24.656 | 45.700 | 26.171 | 1.00 | 0.00 | XXXX | 898 |
| ATOM | 899 | C | ASN A | 132 | −23.526 | 44.689 | 25.984 | 1.00 | 0.00 | XXXX | 899 |
| ATOM | 900 | O | ASN A | 132 | −23.707 | 43.649 | 25.349 | 1.00 | 0.00 | XXXX | 900 |
| ATOM | 901 | CB | ASN A | 132 | −24.977 | 46.387 | 24.841 | 1.00 | 0.00 | XXXX | 901 |
| ATOM | 902 | CG | ASN A | 132 | −23.746 | 46.950 | 24.157 | 1.00 | 0.00 | XXXX | 902 |
| ATOM | 903 | OD1 | ASN A | 132 | −22.991 | 47.724 | 24.745 | 1.00 | 0.00 | XXXX | 903 |
| ATOM | 904 | ND2 | ASN A | 132 | −23.537 | 46.559 | 22.904 | 1.00 | 0.00 | XXXX | 904 |
| ATOM | 905 | N | GLN A | 133 | −22.365 | 44.999 | 26.551 | 1.00 | 0.00 | XXXX | 905 |
| ATOM | 906 | CA | GLN A | 133 | −21.198 | 44.131 | 26.447 | 1.00 | 0.00 | XXXX | 906 |
| ATOM | 907 | C | GLN A | 133 | −20.931 | 43.331 | 27.722 | 1.00 | 0.00 | XXXX | 907 |
| ATOM | 908 | O | GLN A | 133 | −19.924 | 42.630 | 27.815 | 1.00 | 0.00 | XXXX | 908 |
| ATOM | 909 | CB | GLN A | 133 | −19.958 | 44.955 | 26.097 | 1.00 | 0.00 | XXXX | 909 |
| ATOM | 910 | CG | GLN A | 133 | −20.070 | 45.739 | 24.804 | 1.00 | 0.00 | XXXX | 910 |
| ATOM | 911 | CD | GLN A | 133 | −18.871 | 46.638 | 24.572 | 1.00 | 0.00 | XXXX | 911 |

-continued

| | | | | | | | | | | |
|---|---|---|---|---|---|---|---|---|---|---|
| ATOM | 912 | OE1 | GLN A | 133 | −18.403 | 47.316 | 25.487 | 1.00 | 0.00 | XXXX | 912 |
| ATOM | 913 | NE2 | GLN A | 133 | −18.363 | 46.643 | 23.344 | 1.00 | 0.00 | XXXX | 913 |
| ATOM | 914 | N | GLN A | 134 | −21.823 | 43.437 | 28.703 | 1.00 | 0.00 | XXXX | 914 |
| ATOM | 915 | CA | GLN A | 134 | −21.654 | 42.691 | 29.948 | 1.00 | 0.00 | XXXX | 915 |
| ATOM | 916 | C | GLN A | 134 | −22.981 | 42.367 | 30.630 | 1.00 | 0.00 | XXXX | 916 |
| ATOM | 917 | O | GLN A | 134 | −23.469 | 41.240 | 30.555 | 1.00 | 0.00 | XXXX | 917 |
| ATOM | 918 | CB | GLN A | 134 | −20.758 | 43.464 | 30.921 | 1.00 | 0.00 | XXXX | 918 |
| ATOM | 919 | CG | GLN A | 134 | −20.417 | 42.681 | 32.185 | 1.00 | 0.00 | XXXX | 919 |
| ATOM | 920 | CD | GLN A | 134 | −19.788 | 43.542 | 33.264 | 1.00 | 0.00 | XXXX | 920 |
| ATOM | 921 | OE1 | GLN A | 134 | −20.234 | 44.660 | 33.522 | 1.00 | 0.00 | XXXX | 921 |
| ATOM | 922 | NE2 | GLN A | 134 | −18.750 | 43.019 | 33.907 | 1.00 | 0.00 | XXXX | 922 |
| ATOM | 923 | N | ILE A | 135 | −23.556 | 43.363 | 31.296 | 1.00 | 0.00 | XXXX | 923 |
| ATOM | 924 | CA | ILE A | 135 | −24.736 | 43.153 | 32.129 | 1.00 | 0.00 | XXXX | 924 |
| ATOM | 925 | C | ILE A | 135 | −25.935 | 42.612 | 31.350 | 1.00 | 0.00 | XXXX | 925 |
| ATOM | 926 | O | ILE A | 135 | −26.633 | 41.717 | 31.825 | 1.00 | 0.00 | XXXX | 926 |
| ATOM | 927 | CB | ILE A | 135 | −25.151 | 44.455 | 32.838 | 1.00 | 0.00 | XXXX | 927 |
| ATOM | 928 | CG1 | ILE A | 135 | −24.154 | 44.793 | 33.951 | 1.00 | 0.00 | XXXX | 928 |
| ATOM | 929 | CD1 | ILE A | 135 | −24.356 | 46.165 | 34.560 | 1.00 | 0.00 | XXXX | 929 |
| ATOM | 930 | CG2 | ILE A | 135 | −26.548 | 44.324 | 33.415 | 1.00 | 0.00 | XXXX | 930 |
| ATOM | 931 | N | VAL A | 136 | −26.171 | 43.149 | 30.157 | 1.00 | 0.00 | XXXX | 931 |
| ATOM | 932 | CA | VAL A | 136 | −27.332 | 42.745 | 29.368 | 1.00 | 0.00 | XXXX | 932 |
| ATOM | 933 | C | VAL A | 136 | −27.259 | 41.279 | 28.934 | 1.00 | 0.00 | XXXX | 933 |
| ATOM | 934 | O | VAL A | 136 | −28.188 | 40.512 | 29.184 | 1.00 | 0.00 | XXXX | 934 |
| ATOM | 935 | CB | VAL A | 136 | −27.503 | 43.634 | 28.121 | 1.00 | 0.00 | XXXX | 935 |
| ATOM | 936 | CG1 | VAL A | 136 | −28.532 | 43.033 | 27.178 | 1.00 | 0.00 | XXXX | 936 |
| ATOM | 937 | CG2 | VAL A | 136 | −27.904 | 45.043 | 28.529 | 1.00 | 0.00 | XXXX | 937 |
| ATOM | 938 | N | PRO A | 137 | −26.155 | 40.882 | 28.280 | 1.00 | 0.00 | XXXX | 938 |
| ATOM | 939 | CA | PRO A | 137 | −25.986 | 39.469 | 27.919 | 1.00 | 0.00 | XXXX | 939 |
| ATOM | 940 | C | PRO A | 137 | −25.941 | 38.554 | 29.144 | 1.00 | 0.00 | XXXX | 940 |
| ATOM | 941 | O | PRO A | 137 | −26.349 | 37.395 | 29.053 | 1.00 | 0.00 | XXXX | 941 |
| ATOM | 942 | CB | PRO A | 137 | −24.651 | 39.451 | 27.160 | 1.00 | 0.00 | XXXX | 942 |
| ATOM | 943 | CG | PRO A | 137 | −23.976 | 40.738 | 27.506 | 1.00 | 0.00 | XXXX | 943 |
| ATOM | 944 | CD | PRO A | 137 | −25.075 | 41.723 | 27.739 | 1.00 | 0.00 | XXXX | 944 |
| ATOM | 945 | N | ALA A | 138 | −25.456 | 39.071 | 30.270 | 1.00 | 0.00 | XXXX | 945 |
| ATOM | 946 | CA | ALA A | 138 | −25.423 | 38.308 | 31.514 | 1.00 | 0.00 | XXXX | 946 |
| ATOM | 947 | C | ALA A | 138 | −26.836 | 37.914 | 31.933 | 1.00 | 0.00 | XXXX | 947 |
| ATOM | 948 | O | ALA A | 138 | −27.098 | 36.755 | 32.256 | 1.00 | 0.00 | XXXX | 948 |
| ATOM | 949 | CB | ALA A | 138 | −24.742 | 39.111 | 32.618 | 1.00 | 0.00 | XXXX | 949 |
| ATOM | 950 | N | VAL A | 139 | −27.740 | 38.888 | 31.928 | 1.00 | 0.00 | XXXX | 950 |
| ATOM | 951 | CA | VAL A | 139 | −29.134 | 38.642 | 32.277 | 1.00 | 0.00 | XXXX | 951 |
| ATOM | 952 | C | VAL A | 139 | −29.783 | 37.648 | 31.318 | 1.00 | 0.00 | XXXX | 952 |
| ATOM | 953 | O | VAL A | 139 | −30.472 | 36.720 | 31.747 | 1.00 | 0.00 | XXXX | 953 |
| ATOM | 954 | CB | VAL A | 139 | −29.956 | 39.946 | 32.283 | 1.00 | 0.00 | XXXX | 954 |
| ATOM | 955 | CG1 | VAL A | 139 | −31.439 | 39.641 | 32.460 | 1.00 | 0.00 | XXXX | 955 |
| ATOM | 956 | CG2 | VAL A | 139 | −29.457 | 40.880 | 33.377 | 1.00 | 0.00 | XXXX | 956 |
| ATOM | 957 | N | LYS A | 140 | −29.565 | 37.845 | 30.020 | 1.00 | 0.00 | XXXX | 957 |
| ATOM | 958 | CA | LYS A | 140 | −30.161 | 36.974 | 29.012 | 1.00 | 0.00 | XXXX | 958 |
| ATOM | 959 | C | LYS A | 140 | −29.678 | 35.533 | 29.148 | 1.00 | 0.00 | XXXX | 959 |
| ATOM | 960 | O | LYS A | 140 | −30.478 | 34.601 | 29.094 | 1.00 | 0.00 | XXXX | 960 |
| ATOM | 961 | CB | LYS A | 140 | −29.872 | 37.488 | 27.599 | 1.00 | 0.00 | XXXX | 961 |
| ATOM | 962 | CG | LYS A | 140 | −30.590 | 36.683 | 26.523 | 1.00 | 0.00 | XXXX | 962 |
| ATOM | 963 | CD | LYS A | 140 | −30.709 | 37.447 | 25.216 | 1.00 | 0.00 | XXXX | 963 |
| ATOM | 964 | CE | LYS A | 140 | −31.921 | 36.980 | 24.418 | 1.00 | 0.00 | XXXX | 964 |
| ATOM | 965 | NZ | LYS A | 140 | −31.906 | 35.511 | 24.172 | 1.00 | 0.00 | XXXX | 965 |
| ATOM | 966 | N | TRP A | 141 | −28.371 | 35.353 | 29.317 | 1.00 | 0.00 | XXXX | 966 |
| ATOM | 967 | CA | TRP A | 141 | −27.806 | 34.015 | 29.458 | 1.00 | 0.00 | XXXX | 967 |
| ATOM | 968 | C | TRP A | 141 | −28.364 | 33.328 | 30.699 | 1.00 | 0.00 | XXXX | 968 |
| ATOM | 969 | O | TRP A | 141 | −28.711 | 32.146 | 30.665 | 1.00 | 0.00 | XXXX | 969 |
| ATOM | 970 | CB | TRP A | 141 | −26.279 | 34.074 | 29.527 | 1.00 | 0.00 | XXXX | 970 |
| ATOM | 971 | CG | TRP A | 141 | −25.632 | 32.726 | 29.655 | 1.00 | 0.00 | XXXX | 971 |
| ATOM | 972 | CD1 | TRP A | 141 | −25.301 | 31.875 | 28.640 | 1.00 | 0.00 | XXXX | 972 |
| ATOM | 973 | CD2 | TRP A | 141 | −25.231 | 32.076 | 30.869 | 1.00 | 0.00 | XXXX | 973 |
| ATOM | 974 | NE1 | TRP A | 141 | −24.724 | 30.735 | 29.145 | 1.00 | 0.00 | XXXX | 974 |
| ATOM | 975 | CE2 | TRP A | 141 | −24.668 | 30.834 | 30.511 | 1.00 | 0.00 | XXXX | 975 |
| ATOM | 976 | CE3 | TRP A | 141 | −25.294 | 32.423 | 32.222 | 1.00 | 0.00 | XXXX | 976 |
| ATOM | 977 | CZ2 | TRP A | 141 | −24.171 | 29.939 | 31.456 | 1.00 | 0.00 | XXXX | 977 |
| ATOM | 978 | CZ3 | TRP A | 141 | −24.801 | 31.532 | 33.160 | 1.00 | 0.00 | XXXX | 978 |
| ATOM | 979 | CH2 | TRP A | 141 | −24.246 | 30.305 | 32.772 | 1.00 | 0.00 | XXXX | 979 |
| ATOM | 980 | N | LEU A | 142 | −28.446 | 34.079 | 31.792 | 1.00 | 0.00 | XXXX | 980 |
| ATOM | 981 | CA | LEU A | 142 | −29.038 | 33.575 | 33.024 | 1.00 | 0.00 | XXXX | 981 |
| ATOM | 982 | C | LEU A | 142 | −30.481 | 33.149 | 32.788 | 1.00 | 0.00 | XXXX | 982 |
| ATOM | 983 | O | LEU A | 142 | −30.899 | 32.070 | 33.210 | 1.00 | 0.00 | XXXX | 983 |
| ATOM | 984 | CB | LEU A | 142 | −28.969 | 34.631 | 34.128 | 1.00 | 0.00 | XXXX | 984 |
| ATOM | 985 | CG | LEU A | 142 | −27.594 | 34.845 | 34.765 | 1.00 | 0.00 | XXXX | 985 |
| ATOM | 986 | CD1 | LEU A | 142 | −27.621 | 36.018 | 35.732 | 1.00 | 0.00 | XXXX | 986 |
| ATOM | 987 | CD2 | LEU A | 142 | −27.137 | 33.582 | 35.471 | 1.00 | 0.00 | XXXX | 987 |
| ATOM | 988 | N | PHE A | 143 | −31.237 | 34.005 | 32.110 | 1.00 | 0.00 | XXXX | 988 |
| ATOM | 989 | CA | PHE A | 143 | −32.648 | 33.743 | 31.853 | 1.00 | 0.00 | XXXX | 989 |
| ATOM | 990 | C | PHE A | 143 | −32.827 | 32.521 | 30.956 | 1.00 | 0.00 | XXXX | 990 |

-continued

| | | | | | | | | | | |
|---|---|---|---|---|---|---|---|---|---|---|
| ATOM | 991 | O | PHE A | 143 | −33.650 | 31.650 | 31.237 | 1.00 | 0.00 | XXXX | 991 |
| ATOM | 992 | CB | PHE A | 143 | −33.311 | 34.968 | 31.218 | 1.00 | 0.00 | XXXX | 992 |
| ATOM | 993 | CG | PHE A | 143 | −34.799 | 34.837 | 31.055 | 1.00 | 0.00 | XXXX | 993 |
| ATOM | 994 | CD1 | PHE A | 143 | −35.649 | 35.067 | 32.125 | 1.00 | 0.00 | XXXX | 994 |
| ATOM | 995 | CD2 | PHE A | 143 | −35.347 | 34.482 | 29.835 | 1.00 | 0.00 | XXXX | 995 |
| ATOM | 996 | CE1 | PHE A | 143 | −37.020 | 34.949 | 31.979 | 1.00 | 0.00 | XXXX | 996 |
| ATOM | 997 | CE2 | PHE A | 143 | −36.717 | 34.360 | 29.683 | 1.00 | 0.00 | XXXX | 997 |
| ATOM | 998 | CZ | PHE A | 143 | −37.553 | 34.594 | 30.756 | 1.00 | 0.00 | XXXX | 998 |
| ATOM | 999 | N | ASP A | 144 | −32.045 | 32.458 | 29.881 | 1.00 | 0.00 | XXXX | 999 |
| ATOM | 1000 | CA | ASP A | 144 | −32.119 | 31.343 | 28.941 | 1.00 | 0.00 | XXXX | 1000 |
| ATOM | 1001 | C | ASP A | 144 | −31.658 | 30.027 | 29.560 | 1.00 | 0.00 | XXXX | 1001 |
| ATOM | 1002 | O | ASP A | 144 | −31.891 | 28.956 | 28.997 | 1.00 | 0.00 | XXXX | 1002 |
| ATOM | 1003 | CB | ASP A | 144 | −31.292 | 31.642 | 27.688 | 1.00 | 0.00 | XXXX | 1003 |
| ATOM | 1004 | CG | ASP A | 144 | −31.944 | 32.678 | 26.799 | 1.00 | 0.00 | XXXX | 1004 |
| ATOM | 1005 | OD1 | ASP A | 144 | −33.101 | 33.048 | 27.084 | 1.00 | 0.00 | XXXX | 1005 |
| ATOM | 1006 | OD2 | ASP A | 144 | −31.308 | 33.117 | 25.818 | 1.00 | 0.00 | XXXX | 1006 |
| ATOM | 1007 | N | ASN A | 145 | −30.998 | 30.108 | 30.710 | 1.00 | 0.00 | XXXX | 1007 |
| ATOM | 1008 | CA | ASN A | 145 | −30.560 | 28.907 | 31.411 | 1.00 | 0.00 | XXXX | 1008 |
| ATOM | 1009 | C | ASN A | 145 | −31.353 | 28.653 | 32.693 | 1.00 | 0.00 | XXXX | 1009 |
| ATOM | 1010 | O | ASN A | 145 | −30.859 | 28.019 | 33.625 | 1.00 | 0.00 | XXXX | 1010 |
| ATOM | 1011 | CB | ASN A | 145 | −29.065 | 28.988 | 31.717 | 1.00 | 0.00 | XXXX | 1011 |
| ATOM | 1012 | CG | ASN A | 145 | −28.210 | 28.738 | 30.488 | 1.00 | 0.00 | XXXX | 1012 |
| ATOM | 1013 | OD1 | ASN A | 145 | −27.887 | 27.594 | 30.165 | 1.00 | 0.00 | XXXX | 1013 |
| ATOM | 1014 | ND2 | ASN A | 145 | −27.843 | 29.809 | 29.791 | 1.00 | 0.00 | XXXX | 1014 |
| ATOM | 1015 | N | GLY A | 146 | −32.585 | 29.151 | 32.730 | 1.00 | 0.00 | XXXX | 1015 |
| ATOM | 1016 | CA | GLY A | 146 | −33.528 | 28.778 | 33.770 | 1.00 | 0.00 | XXXX | 1016 |
| ATOM | 1017 | C | GLY A | 146 | −33.654 | 29.689 | 34.978 | 1.00 | 0.00 | XXXX | 1017 |
| ATOM | 1018 | O | GLY A | 146 | −34.473 | 29.430 | 35.860 | 1.00 | 0.00 | XXXX | 1018 |
| ATOM | 1019 | N | LYS A | 147 | −32.859 | 30.752 | 35.033 | 1.00 | 0.00 | XXXX | 1019 |
| ATOM | 1020 | CA | LYS A | 147 | −32.948 | 31.687 | 36.151 | 1.00 | 0.00 | XXXX | 1020 |
| ATOM | 1021 | C | LYS A | 147 | −33.997 | 32.764 | 35.885 | 1.00 | 0.00 | XXXX | 1021 |
| ATOM | 1022 | O | LYS A | 147 | −33.801 | 33.639 | 35.043 | 1.00 | 0.00 | XXXX | 1022 |
| ATOM | 1023 | CB | LYS A | 147 | −31.588 | 32.330 | 36.429 | 1.00 | 0.00 | XXXX | 1023 |
| ATOM | 1024 | CG | LYS A | 147 | −30.446 | 31.336 | 36.534 | 1.00 | 0.00 | XXXX | 1024 |
| ATOM | 1025 | CD | LYS A | 147 | −30.761 | 30.239 | 37.537 | 1.00 | 0.00 | XXXX | 1025 |
| ATOM | 1026 | CE | LYS A | 147 | −29.720 | 29.135 | 37.485 | 1.00 | 0.00 | XXXX | 1026 |
| ATOM | 1027 | NZ | LYS A | 147 | −30.003 | 28.062 | 38.480 | 1.00 | 0.00 | XXXX | 1027 |
| ATOM | 1028 | N | LYS A | 148 | −35.109 | 32.695 | 36.612 | 1.00 | 0.00 | XXXX | 1028 |
| ATOM | 1029 | CA | LYS A | 148 | −36.242 | 33.581 | 36.366 | 1.00 | 0.00 | XXXX | 1029 |
| ATOM | 1030 | C | LYS A | 148 | −36.437 | 34.585 | 37.498 | 1.00 | 0.00 | XXXX | 1030 |
| ATOM | 1031 | O | LYS A | 148 | −36.973 | 35.673 | 37.287 | 1.00 | 0.00 | XXXX | 1031 |
| ATOM | 1032 | CB | LYS A | 148 | −37.525 | 32.767 | 36.183 | 1.00 | 0.00 | XXXX | 1032 |
| ATOM | 1033 | CG | LYS A | 148 | −37.399 | 31.596 | 35.224 | 1.00 | 0.00 | XXXX | 1033 |
| ATOM | 1034 | CD | LYS A | 148 | −37.052 | 32.056 | 33.820 | 1.00 | 0.00 | XXXX | 1034 |
| ATOM | 1035 | CE | LYS A | 148 | −36.840 | 30.869 | 32.893 | 1.00 | 0.00 | XXXX | 1035 |
| ATOM | 1036 | NZ | LYS A | 148 | −36.646 | 31.303 | 31.484 | 1.00 | 0.00 | XXXX | 1036 |
| ATOM | 1037 | N | ARG A | 149 | −36.005 | 34.211 | 38.698 | 1.00 | 0.00 | XXXX | 1037 |
| ATOM | 1038 | CA | ARG A | 149 | −36.248 | 35.020 | 39.887 | 1.00 | 0.00 | XXXX | 1038 |
| ATOM | 1039 | C | ARG A | 149 | −34.948 | 35.592 | 40.441 | 1.00 | 0.00 | XXXX | 1039 |
| ATOM | 1040 | O | ARG A | 149 | −34.189 | 34.900 | 41.121 | 1.00 | 0.00 | XXXX | 1040 |
| ATOM | 1041 | CB | ARG A | 149 | −36.970 | 34.188 | 40.947 | 1.00 | 0.00 | XXXX | 1041 |
| ATOM | 1042 | CG | ARG A | 149 | −38.304 | 33.625 | 40.464 | 1.00 | 0.00 | XXXX | 1042 |
| ATOM | 1043 | CD | ARG A | 149 | −38.805 | 32.500 | 41.357 | 1.00 | 0.00 | XXXX | 1043 |
| ATOM | 1044 | NE | ARG A | 149 | −38.904 | 32.917 | 42.750 | 1.00 | 0.00 | XXXX | 1044 |
| ATOM | 1045 | CZ | ARG A | 149 | −38.052 | 32.546 | 43.700 | 1.00 | 0.00 | XXXX | 1045 |
| ATOM | 1046 | NH1 | ARG A | 149 | −37.033 | 31.746 | 43.405 | 1.00 | 0.00 | XXXX | 1046 |
| ATOM | 1047 | NH2 | ARG A | 149 | −38.214 | 32.974 | 44.944 | 1.00 | 0.00 | XXXX | 1047 |
| ATOM | 1048 | N | PHE A | 150 | −34.708 | 36.865 | 40.149 | 1.00 | 0.00 | XXXX | 1048 |
| ATOM | 1049 | CA | PHE A | 150 | −33.449 | 37.518 | 40.488 | 1.00 | 0.00 | XXXX | 1049 |
| ATOM | 1050 | C | PHE A | 150 | −33.486 | 38.203 | 41.849 | 1.00 | 0.00 | XXXX | 1050 |
| ATOM | 1051 | O | PHE A | 150 | −34.455 | 38.881 | 42.187 | 1.00 | 0.00 | XXXX | 1051 |
| ATOM | 1052 | CB | PHE A | 150 | −33.087 | 38.553 | 39.417 | 1.00 | 0.00 | XXXX | 1052 |
| ATOM | 1053 | CG | PHE A | 150 | −32.553 | 37.958 | 38.144 | 1.00 | 0.00 | XXXX | 1053 |
| ATOM | 1054 | CD1 | PHE A | 150 | −33.159 | 36.856 | 37.562 | 1.00 | 0.00 | XXXX | 1054 |
| ATOM | 1055 | CD2 | PHE A | 150 | −31.453 | 38.518 | 37.517 | 1.00 | 0.00 | XXXX | 1055 |
| ATOM | 1056 | CE1 | PHE A | 150 | −32.666 | 36.316 | 36.388 | 1.00 | 0.00 | XXXX | 1056 |
| ATOM | 1057 | CE2 | PHE A | 150 | −30.957 | 37.985 | 36.342 | 1.00 | 0.00 | XXXX | 1057 |
| ATOM | 1058 | CZ | PHE A | 150 | −31.565 | 36.882 | 35.777 | 1.00 | 0.00 | XXXX | 1058 |
| ATOM | 1059 | N | TYR A | 151 | −32.422 | 38.024 | 42.625 | 1.00 | 0.00 | XXXX | 1059 |
| ATOM | 1060 | CA | TYR A | 151 | −32.211 | 38.827 | 43.822 | 1.00 | 0.00 | XXXX | 1060 |
| ATOM | 1061 | C | TYR A | 151 | −31.055 | 39.787 | 43.565 | 1.00 | 0.00 | XXXX | 1061 |
| ATOM | 1062 | O | TYR A | 151 | −29.930 | 39.360 | 43.303 | 1.00 | 0.00 | XXXX | 1062 |
| ATOM | 1063 | CB | TYR A | 151 | −31.929 | 37.949 | 45.043 | 1.00 | 0.00 | XXXX | 1063 |
| ATOM | 1064 | CG | TYR A | 151 | −32.159 | 38.653 | 46.364 | 1.00 | 0.00 | XXXX | 1064 |
| ATOM | 1065 | CD1 | TYR A | 151 | −33.262 | 38.348 | 47.152 | 1.00 | 0.00 | XXXX | 1065 |
| ATOM | 1066 | CD2 | TYR A | 151 | −31.287 | 39.638 | 46.812 | 1.00 | 0.00 | XXXX | 1066 |
| ATOM | 1067 | CE1 | TYR A | 151 | −33.482 | 38.992 | 48.356 | 1.00 | 0.00 | XXXX | 1067 |
| ATOM | 1068 | CE2 | TYR A | 151 | −31.498 | 40.288 | 48.015 | 1.00 | 0.00 | XXXX | 1068 |
| ATOM | 1069 | CZ | TYR A | 151 | −32.597 | 39.961 | 48.782 | 1.00 | 0.00 | XXXX | 1069 |

-continued

| | | | | | | | | | | |
|---|---|---|---|---|---|---|---|---|---|---|
| ATOM | 1070 | OH | TYR A | 151 | −32.812 | 40.605 | 49.979 | 1.00 | 0.00 XXXX | 1070 |
| ATOM | 1071 | N | LEU A | 152 | −31.339 | 41.083 | 43.632 | 1.00 | 0.00 XXXX | 1071 |
| ATOM | 1072 | CA | LEU A | 152 | −30.340 | 42.098 | 43.316 | 1.00 | 0.00 XXXX | 1072 |
| ATOM | 1073 | C | LEU A | 152 | −29.632 | 42.616 | 44.564 | 1.00 | 0.00 XXXX | 1073 |
| ATOM | 1074 | O | LEU A | 152 | −30.272 | 43.051 | 45.521 | 1.00 | 0.00 XXXX | 1074 |
| ATOM | 1075 | CB | LEU A | 152 | −30.990 | 43.258 | 42.560 | 1.00 | 0.00 XXXX | 1075 |
| ATOM | 1076 | CG | LEU A | 152 | −31.824 | 42.858 | 41.340 | 1.00 | 0.00 XXXX | 1076 |
| ATOM | 1077 | CD1 | LEU A | 152 | −32.433 | 44.085 | 40.678 | 1.00 | 0.00 XXXX | 1077 |
| ATOM | 1078 | CD2 | LEU A | 152 | −30.980 | 42.068 | 40.349 | 1.00 | 0.00 XXXX | 1078 |
| ATOM | 1079 | N | LEU A | 153 | −28.305 | 42.562 | 44.542 | 1.00 | 0.00 XXXX | 1079 |
| ATOM | 1080 | CA | LEU A | 153 | −27.491 | 43.051 | 45.646 | 1.00 | 0.00 XXXX | 1080 |
| ATOM | 1081 | C | LEU A | 153 | −26.286 | 43.819 | 45.119 | 1.00 | 0.00 XXXX | 1081 |
| ATOM | 1082 | O | LEU A | 153 | −25.509 | 43.294 | 44.323 | 1.00 | 0.00 XXXX | 1082 |
| ATOM | 1083 | CB | LEU A | 153 | −27.030 | 41.892 | 46.532 | 1.00 | 0.00 XXXX | 1083 |
| ATOM | 1084 | CG | LEU A | 153 | −25.990 | 42.236 | 47.603 | 1.00 | 0.00 XXXX | 1084 |
| ATOM | 1085 | CD1 | LEU A | 153 | −26.593 | 43.142 | 48.669 | 1.00 | 0.00 XXXX | 1085 |
| ATOM | 1086 | CD2 | LEU A | 153 | −25.402 | 40.976 | 48.226 | 1.00 | 0.00 XXXX | 1086 |
| ATOM | 1087 | N | GLY A | 154 | −26.135 | 45.063 | 45.559 | 1.00 | 0.00 XXXX | 1087 |
| ATOM | 1088 | CA | GLY A | 154 | −25.026 | 45.889 | 45.119 | 1.00 | 0.00 XXXX | 1088 |
| ATOM | 1089 | C | GLY A | 154 | −24.634 | 46.961 | 46.115 | 1.00 | 0.00 XXXX | 1089 |
| ATOM | 1090 | O | GLY A | 154 | −25.306 | 47.164 | 47.127 | 1.00 | 0.00 XXXX | 1090 |
| ATOM | 1091 | N | SER A | 155 | −23.535 | 47.651 | 45.827 | 1.00 | 0.00 XXXX | 1091 |
| ATOM | 1092 | CA | SER A | 155 | −23.095 | 48.766 | 46.655 | 1.00 | 0.00 XXXX | 1092 |
| ATOM | 1093 | C | SER A | 155 | −23.945 | 49.996 | 46.364 | 1.00 | 0.00 XXXX | 1093 |
| ATOM | 1094 | O | SER A | 155 | −24.453 | 50.158 | 45.256 | 1.00 | 0.00 XXXX | 1094 |
| ATOM | 1095 | CB | SER A | 155 | −21.615 | 49.064 | 46.418 | 1.00 | 0.00 XXXX | 1095 |
| ATOM | 1096 | OG | SER A | 155 | −20.822 | 47.923 | 46.705 | 1.00 | 0.00 XXXX | 1096 |
| ATOM | 1097 | N | ASP A | 156 | −24.101 | 50.859 | 47.362 | 1.00 | 0.00 XXXX | 1097 |
| ATOM | 1098 | CA | ASP A | 156 | −25.017 | 51.989 | 47.249 | 1.00 | 0.00 XXXX | 1098 |
| ATOM | 1099 | C | ASP A | 156 | −24.390 | 53.203 | 46.564 | 1.00 | 0.00 XXXX | 1099 |
| ATOM | 1100 | O | ASP A | 156 | −23.934 | 54.133 | 47.228 | 1.00 | 0.00 XXXX | 1100 |
| ATOM | 1101 | CB | ASP A | 156 | −25.535 | 52.390 | 48.632 | 1.00 | 0.00 XXXX | 1101 |
| ATOM | 1102 | CG | ASP A | 156 | −26.815 | 53.199 | 48.560 | 1.00 | 0.00 XXXX | 1102 |
| ATOM | 1103 | OD1 | ASP A | 156 | −27.198 | 53.611 | 47.445 | 1.00 | 0.00 XXXX | 1103 |
| ATOM | 1104 | OD2 | ASP A | 156 | −27.443 | 53.419 | 49.617 | 1.00 | 0.00 XXXX | 1104 |
| ATOM | 1105 | N | TYR A | 157 | −24.372 | 53.185 | 45.235 | 1.00 | 0.00 XXXX | 1105 |
| ATOM | 1106 | CA | TYR A | 157 | −23.993 | 54.357 | 44.453 | 1.00 | 0.00 XXXX | 1106 |
| ATOM | 1107 | C | TYR A | 157 | −24.489 | 54.182 | 43.019 | 1.00 | 0.00 XXXX | 1107 |
| ATOM | 1108 | O | TYR A | 157 | −25.240 | 53.251 | 42.731 | 1.00 | 0.00 XXXX | 1108 |
| ATOM | 1109 | CB | TYR A | 157 | −22.478 | 54.602 | 44.505 | 1.00 | 0.00 XXXX | 1109 |
| ATOM | 1110 | CG | TYR A | 157 | −21.622 | 53.583 | 43.791 | 1.00 | 0.00 XXXX | 1110 |
| ATOM | 1111 | CD1 | TYR A | 157 | −21.055 | 53.870 | 42.555 | 1.00 | 0.00 XXXX | 1111 |
| ATOM | 1112 | CD2 | TYR A | 157 | −21.356 | 52.344 | 44.362 | 1.00 | 0.00 XXXX | 1112 |
| ATOM | 1113 | CE1 | TYR A | 157 | −20.262 | 52.948 | 41.899 | 1.00 | 0.00 XXXX | 1113 |
| ATOM | 1114 | CE2 | TYR A | 157 | −20.564 | 51.413 | 43.711 | 1.00 | 0.00 XXXX | 1114 |
| ATOM | 1115 | CZ | TYR A | 157 | −20.019 | 51.723 | 42.480 | 1.00 | 0.00 XXXX | 1115 |
| ATOM | 1116 | OH | TYR A | 157 | −19.231 | 50.803 | 41.827 | 1.00 | 0.00 XXXX | 1116 |
| ATOM | 1117 | N | VAL A | 158 | −24.074 | 55.069 | 42.121 | 1.00 | 0.00 XXXX | 1117 |
| ATOM | 1118 | CA | VAL A | 158 | −24.753 | 55.206 | 40.835 | 1.00 | 0.00 XXXX | 1118 |
| ATOM | 1119 | C | VAL A | 158 | −24.658 | 53.985 | 39.914 | 1.00 | 0.00 XXXX | 1119 |
| ATOM | 1120 | O | VAL A | 158 | −25.600 | 53.704 | 39.172 | 1.00 | 0.00 XXXX | 1120 |
| ATOM | 1121 | CB | VAL A | 158 | −24.229 | 56.433 | 40.061 | 1.00 | 0.00 XXXX | 1121 |
| ATOM | 1122 | CG1 | VAL A | 158 | −22.766 | 56.250 | 39.685 | 1.00 | 0.00 XXXX | 1122 |
| ATOM | 1123 | CG2 | VAL A | 158 | −25.080 | 56.680 | 38.823 | 1.00 | 0.00 XXXX | 1123 |
| ATOM | 1124 | N | PHE A | 159 | −23.546 | 53.255 | 39.950 | 1.00 | 0.00 XXXX | 1124 |
| ATOM | 1125 | CA | PHE A | 159 | −23.413 | 52.113 | 39.046 | 1.00 | 0.00 XXXX | 1125 |
| ATOM | 1126 | C | PHE A | 159 | −24.408 | 50.997 | 39.356 | 1.00 | 0.00 XXXX | 1126 |
| ATOM | 1127 | O | PHE A | 159 | −25.187 | 50.606 | 38.488 | 1.00 | 0.00 XXXX | 1127 |
| ATOM | 1128 | CB | PHE A | 159 | −22.000 | 51.527 | 39.067 | 1.00 | 0.00 XXXX | 1128 |
| ATOM | 1129 | CG | PHE A | 159 | −21.938 | 50.132 | 38.506 | 1.00 | 0.00 XXXX | 1129 |
| ATOM | 1130 | CD1 | PHE A | 159 | −22.242 | 49.897 | 37.174 | 1.00 | 0.00 XXXX | 1130 |
| ATOM | 1131 | CD2 | PHE A | 159 | −21.615 | 49.055 | 39.315 | 1.00 | 0.00 XXXX | 1131 |
| ATOM | 1132 | CE1 | PHE A | 159 | −22.208 | 48.617 | 36.654 | 1.00 | 0.00 XXXX | 1132 |
| ATOM | 1133 | CE2 | PHE A | 159 | −21.578 | 47.771 | 38.800 | 1.00 | 0.00 XXXX | 1133 |
| ATOM | 1134 | CZ | PHE A | 159 | −21.876 | 47.552 | 37.468 | 1.00 | 0.00 XXXX | 1134 |
| ATOM | 1135 | N | PRO A | 160 | −24.383 | 50.473 | 40.593 | 1.00 | 0.00 XXXX | 1135 |
| ATOM | 1136 | CA | PRO A | 160 | −25.294 | 49.377 | 40.934 | 1.00 | 0.00 XXXX | 1136 |
| ATOM | 1137 | C | PRO A | 160 | −26.766 | 49.766 | 40.808 | 1.00 | 0.00 XXXX | 1137 |
| ATOM | 1138 | O | PRO A | 160 | −27.576 | 48.945 | 40.379 | 1.00 | 0.00 XXXX | 1138 |
| ATOM | 1139 | CB | PRO A | 160 | −24.933 | 49.070 | 42.390 | 1.00 | 0.00 XXXX | 1139 |
| ATOM | 1140 | CG | PRO A | 160 | −23.503 | 49.495 | 42.508 | 1.00 | 0.00 XXXX | 1140 |
| ATOM | 1141 | CD | PRO A | 160 | −23.422 | 50.742 | 41.677 | 1.00 | 0.00 XXXX | 1141 |
| ATOM | 1142 | N | ARG A | 161 | −27.107 | 50.999 | 41.169 | 1.00 | 0.00 XXXX | 1142 |
| ATOM | 1143 | CA | ARG A | 161 | −28.489 | 51.458 | 41.053 | 1.00 | 0.00 XXXX | 1143 |
| ATOM | 1144 | C | ARG A | 161 | −28.929 | 51.547 | 39.591 | 1.00 | 0.00 XXXX | 1144 |
| ATOM | 1145 | O | ARG A | 161 | −30.036 | 51.133 | 39.244 | 1.00 | 0.00 XXXX | 1145 |
| ATOM | 1146 | CB | ARG A | 161 | −28.673 | 52.803 | 41.759 | 1.00 | 0.00 XXXX | 1146 |
| ATOM | 1147 | CG | ARG A | 161 | −28.525 | 52.704 | 43.271 | 1.00 | 0.00 XXXX | 1147 |
| ATOM | 1148 | CD | ARG A | 161 | −29.255 | 53.824 | 43.995 | 1.00 | 0.00 XXXX | 1148 |

-continued

| ATOM | 1149 | NE | ARG A | 161 | −29.287 | 53.606 | 45.440 | 1.00 | 0.00 | XXXX | 1149 |
| ATOM | 1150 | CZ | ARG A | 161 | −30.300 | 53.041 | 46.092 | 1.00 | 0.00 | XXXX | 1150 |
| ATOM | 1151 | NH1 | ARG A | 161 | −31.377 | 52.637 | 45.432 | 1.00 | 0.00 | XXXX | 1151 |
| ATOM | 1152 | NH2 | ARG A | 161 | −30.238 | 52.884 | 47.407 | 1.00 | 0.00 | XXXX | 1152 |
| ATOM | 1153 | N | THR A | 162 | −28.065 | 52.088 | 38.738 | 1.00 | 0.00 | XXXX | 1153 |
| ATOM | 1154 | CA | THR A | 162 | −28.381 | 52.206 | 37.318 | 1.00 | 0.00 | XXXX | 1154 |
| ATOM | 1155 | C | THR A | 162 | −28.354 | 50.834 | 36.658 | 1.00 | 0.00 | XXXX | 1155 |
| ATOM | 1156 | O | THR A | 162 | −29.189 | 50.529 | 35.806 | 1.00 | 0.00 | XXXX | 1156 |
| ATOM | 1157 | CB | THR A | 162 | −27.404 | 53.140 | 36.583 | 1.00 | 0.00 | XXXX | 1157 |
| ATOM | 1158 | OG1 | THR A | 162 | −27.400 | 54.427 | 37.214 | 1.00 | 0.00 | XXXX | 1158 |
| ATOM | 1159 | CG2 | THR A | 162 | −27.822 | 53.301 | 35.130 | 1.00 | 0.00 | XXXX | 1159 |
| ATOM | 1160 | N | ALA A | 163 | −27.384 | 50.015 | 37.053 | 1.00 | 0.00 | XXXX | 1160 |
| ATOM | 1161 | CA | ALA A | 163 | −27.275 | 48.651 | 36.550 | 1.00 | 0.00 | XXXX | 1161 |
| ATOM | 1162 | C | ALA A | 163 | −28.552 | 47.867 | 36.831 | 1.00 | 0.00 | XXXX | 1162 |
| ATOM | 1163 | O | ALA A | 163 | −29.070 | 47.173 | 35.958 | 1.00 | 0.00 | XXXX | 1163 |
| ATOM | 1164 | CB | ALA A | 163 | −26.075 | 47.951 | 37.167 | 1.00 | 0.00 | XXXX | 1164 |
| ATOM | 1165 | N | ASN A | 164 | −29.052 | 47.979 | 38.058 | 1.00 | 0.00 | XXXX | 1165 |
| ATOM | 1166 | CA | ASN A | 164 | −30.260 | 47.265 | 38.455 | 1.00 | 0.00 | XXXX | 1166 |
| ATOM | 1167 | C | ASN A | 164 | −31.510 | 47.822 | 37.783 | 1.00 | 0.00 | XXXX | 1167 |
| ATOM | 1168 | O | ASN A | 164 | −32.461 | 47.084 | 37.523 | 1.00 | 0.00 | XXXX | 1168 |
| ATOM | 1169 | CB | ASN A | 164 | −30.425 | 47.298 | 39.976 | 1.00 | 0.00 | XXXX | 1169 |
| ATOM | 1170 | CG | ASN A | 164 | −29.421 | 46.412 | 40.689 | 1.00 | 0.00 | XXXX | 1170 |
| ATOM | 1171 | OD1 | ASN A | 164 | −28.889 | 45.465 | 40.108 | 1.00 | 0.00 | XXXX | 1171 |
| ATOM | 1172 | ND2 | ASN A | 164 | −29.161 | 46.712 | 41.956 | 1.00 | 0.00 | XXXX | 1172 |
| ATOM | 1173 | N | LYS A | 165 | −31.510 | 49.123 | 37.510 | 1.00 | 0.00 | XXXX | 1173 |
| ATOM | 1174 | CA | LYS A | 165 | −32.591 | 49.731 | 36.745 | 1.00 | 0.00 | XXXX | 1174 |
| ATOM | 1175 | C | LYS A | 165 | −32.645 | 49.117 | 35.349 | 1.00 | 0.00 | XXXX | 1175 |
| ATOM | 1176 | O | LYS A | 165 | −33.721 | 48.836 | 34.822 | 1.00 | 0.00 | XXXX | 1176 |
| ATOM | 1177 | CB | LYS A | 165 | −32.417 | 51.249 | 36.656 | 1.00 | 0.00 | XXXX | 1177 |
| ATOM | 1178 | CG | LYS A | 165 | −33.538 | 51.953 | 35.903 | 1.00 | 0.00 | XXXX | 1178 |
| ATOM | 1179 | CD | LYS A | 165 | −33.278 | 53.446 | 35.773 | 1.00 | 0.00 | XXXX | 1179 |
| ATOM | 1180 | CE | LYS A | 165 | −34.408 | 54.139 | 35.023 | 1.00 | 0.00 | XXXX | 1180 |
| ATOM | 1181 | NZ | LYS A | 165 | −34.229 | 55.617 | 34.977 | 1.00 | 0.00 | XXXX | 1181 |
| ATOM | 1182 | N | ILE A | 166 | −31.471 | 48.909 | 34.760 | 1.00 | 0.00 | XXXX | 1182 |
| ATOM | 1183 | CA | ILE A | 166 | −31.367 | 48.263 | 33.458 | 1.00 | 0.00 | XXXX | 1183 |
| ATOM | 1184 | C | ILE A | 166 | −31.808 | 46.804 | 33.536 | 1.00 | 0.00 | XXXX | 1184 |
| ATOM | 1185 | O | ILE A | 166 | −32.578 | 46.331 | 32.701 | 1.00 | 0.00 | XXXX | 1185 |
| ATOM | 1186 | CB | ILE A | 166 | −29.929 | 48.327 | 32.908 | 1.00 | 0.00 | XXXX | 1186 |
| ATOM | 1187 | CG1 | ILE A | 166 | −29.534 | 49.776 | 32.613 | 1.00 | 0.00 | XXXX | 1187 |
| ATOM | 1188 | CG2 | ILE A | 166 | −29.797 | 47.468 | 31.659 | 1.00 | 0.00 | XXXX | 1188 |
| ATOM | 1189 | CD1 | ILE A | 166 | −28.062 | 49.955 | 32.308 | 1.00 | 0.00 | XXXX | 1189 |
| ATOM | 1190 | N | ILE A | 167 | −31.311 | 46.098 | 34.547 | 1.00 | 0.00 | XXXX | 1190 |
| ATOM | 1191 | CA | ILE A | 167 | −31.627 | 44.686 | 34.730 | 1.00 | 0.00 | XXXX | 1191 |
| ATOM | 1192 | C | ILE A | 167 | −33.129 | 44.457 | 34.890 | 1.00 | 0.00 | XXXX | 1192 |
| ATOM | 1193 | O | ILE A | 167 | −33.686 | 43.520 | 34.319 | 1.00 | 0.00 | XXXX | 1193 |
| ATOM | 1194 | CB | ILE A | 167 | −30.893 | 44.102 | 35.951 | 1.00 | 0.00 | XXXX | 1194 |
| ATOM | 1195 | CG1 | ILE A | 167 | −29.378 | 44.124 | 35.722 | 1.00 | 0.00 | XXXX | 1195 |
| ATOM | 1196 | CG2 | ILE A | 167 | −31.364 | 42.685 | 36.226 | 1.00 | 0.00 | XXXX | 1196 |
| ATOM | 1197 | CD1 | ILE A | 167 | −28.573 | 43.673 | 36.923 | 1.00 | 0.00 | XXXX | 1197 |
| ATOM | 1198 | N | LYS A | 168 | −33.781 | 45.315 | 35.668 | 1.00 | 0.00 | XXXX | 1198 |
| ATOM | 1199 | CA | LYS A | 168 | −35.219 | 45.192 | 35.890 | 1.00 | 0.00 | XXXX | 1199 |
| ATOM | 1200 | C | LYS A | 168 | −36.009 | 45.426 | 34.604 | 1.00 | 0.00 | XXXX | 1200 |
| ATOM | 1201 | O | LYS A | 168 | −37.017 | 44.763 | 34.357 | 1.00 | 0.00 | XXXX | 1201 |
| ATOM | 1202 | CB | LYS A | 168 | −35.681 | 46.162 | 36.981 | 1.00 | 0.00 | XXXX | 1202 |
| ATOM | 1203 | CG | LYS A | 168 | −35.259 | 45.749 | 38.383 | 1.00 | 0.00 | XXXX | 1203 |
| ATOM | 1204 | CD | LYS A | 168 | −35.986 | 46.548 | 39.454 | 1.00 | 0.00 | XXXX | 1204 |
| ATOM | 1205 | CE | LYS A | 168 | −35.275 | 47.855 | 39.752 | 1.00 | 0.00 | XXXX | 1205 |
| ATOM | 1206 | NZ | LYS A | 168 | −35.812 | 48.506 | 40.979 | 1.00 | 0.00 | XXXX | 1206 |
| ATOM | 1207 | N | ALA A | 169 | −35.555 | 46.375 | 33.792 | 1.00 | 0.00 | XXXX | 1207 |
| ATOM | 1208 | CA | ALA A | 169 | −36.215 | 46.671 | 32.527 | 1.00 | 0.00 | XXXX | 1208 |
| ATOM | 1209 | C | ALA A | 169 | −36.105 | 45.490 | 31.568 | 1.00 | 0.00 | XXXX | 1209 |
| ATOM | 1210 | O | ALA A | 169 | −37.058 | 45.158 | 30.862 | 1.00 | 0.00 | XXXX | 1210 |
| ATOM | 1211 | CB | ALA A | 169 | −35.624 | 47.924 | 31.899 | 1.00 | 0.00 | XXXX | 1211 |
| ATOM | 1212 | N | TYR A | 170 | −34.935 | 44.858 | 31.552 | 1.00 | 0.00 | XXXX | 1212 |
| ATOM | 1213 | CA | TYR A | 170 | −34.683 | 43.725 | 30.670 | 1.00 | 0.00 | XXXX | 1213 |
| ATOM | 1214 | C | TYR A | 170 | −35.464 | 42.495 | 31.124 | 1.00 | 0.00 | XXXX | 1214 |
| ATOM | 1215 | O | TYR A | 170 | −36.057 | 41.789 | 30.307 | 1.00 | 0.00 | XXXX | 1215 |
| ATOM | 1216 | CB | TYR A | 170 | −33.185 | 43.414 | 30.616 | 1.00 | 0.00 | XXXX | 1216 |
| ATOM | 1217 | CG | TYR A | 170 | −32.768 | 42.565 | 29.433 | 1.00 | 0.00 | XXXX | 1217 |
| ATOM | 1218 | CD1 | TYR A | 170 | −33.630 | 42.349 | 28.365 | 1.00 | 0.00 | XXXX | 1218 |
| ATOM | 1219 | CD2 | TYR A | 170 | −31.506 | 41.989 | 29.381 | 1.00 | 0.00 | XXXX | 1219 |
| ATOM | 1220 | CE1 | TYR A | 170 | −33.249 | 41.576 | 27.281 | 1.00 | 0.00 | XXXX | 1220 |
| ATOM | 1221 | CE2 | TYR A | 170 | −31.115 | 41.215 | 28.303 | 1.00 | 0.00 | XXXX | 1221 |
| ATOM | 1222 | CZ | TYR A | 170 | −31.988 | 41.013 | 27.256 | 1.00 | 0.00 | XXXX | 1222 |
| ATOM | 1223 | OH | TYR A | 170 | −31.597 | 40.245 | 26.184 | 1.00 | 0.00 | XXXX | 1223 |
| ATOM | 1224 | N | LEU A | 171 | −35.456 | 42.242 | 32.430 | 1.00 | 0.00 | XXXX | 1224 |
| ATOM | 1225 | CA | LEU A | 171 | −36.195 | 41.119 | 32.998 | 1.00 | 0.00 | XXXX | 1225 |
| ATOM | 1226 | C | LEU A | 171 | −37.689 | 41.218 | 32.712 | 1.00 | 0.00 | XXXX | 1226 |
| ATOM | 1227 | O | LEU A | 171 | −38.337 | 40.215 | 32.414 | 1.00 | 0.00 | XXXX | 1227 |

-continued

| | | | | | | | | | | |
|---|---|---|---|---|---|---|---|---|---|---|
| ATOM | 1228 | CB | LEU A | 171 | −35.959 | 41.030 | 34.508 | 1.00 | 0.00 | XXXX | 1228 |
| ATOM | 1229 | CG | LEU A | 171 | −34.695 | 40.285 | 34.936 | 1.00 | 0.00 | XXXX | 1229 |
| ATOM | 1230 | CD1 | LEU A | 171 | −34.537 | 40.317 | 36.451 | 1.00 | 0.00 | XXXX | 1230 |
| ATOM | 1231 | CD2 | LEU A | 171 | −34.729 | 38.852 | 34.421 | 1.00 | 0.00 | XXXX | 1231 |
| ATOM | 1232 | N | LYS A | 172 | −38.233 | 42.426 | 32.809 | 1.00 | 0.00 | XXXX | 1232 |
| ATOM | 1233 | CA | LYS A | 172 | −39.637 | 42.650 | 32.482 | 1.00 | 0.00 | XXXX | 1233 |
| ATOM | 1234 | C | LYS A | 172 | −39.890 | 42.298 | 31.021 | 1.00 | 0.00 | XXXX | 1234 |
| ATOM | 1235 | O | LYS A | 172 | −40.915 | 41.708 | 30.676 | 1.00 | 0.00 | XXXX | 1235 |
| ATOM | 1236 | CB | LYS A | 172 | −40.039 | 44.100 | 32.759 | 1.00 | 0.00 | XXXX | 1236 |
| ATOM | 1237 | CG | LYS A | 172 | −41.459 | 44.442 | 32.329 | 1.00 | 0.00 | XXXX | 1237 |
| ATOM | 1238 | CD | LYS A | 172 | −41.829 | 45.868 | 32.704 | 1.00 | 0.00 | XXXX | 1238 |
| ATOM | 1239 | CE | LYS A | 172 | −43.289 | 46.164 | 32.391 | 1.00 | 0.00 | XXXX | 1239 |
| ATOM | 1240 | NZ | LYS A | 172 | −43.607 | 45.977 | 30.947 | 1.00 | 0.00 | XXXX | 1240 |
| ATOM | 1241 | N | TYR A | 173 | −38.942 | 42.666 | 30.167 | 1.00 | 0.00 | XXXX | 1241 |
| ATOM | 1242 | CA | TYR A | 173 | −39.034 | 42.386 | 28.742 | 1.00 | 0.00 | XXXX | 1242 |
| ATOM | 1243 | C | TYR A | 173 | −38.992 | 40.885 | 28.470 | 1.00 | 0.00 | XXXX | 1243 |
| ATOM | 1244 | O | TYR A | 173 | −39.712 | 40.382 | 27.608 | 1.00 | 0.00 | XXXX | 1244 |
| ATOM | 1245 | CB | TYR A | 173 | −37.906 | 43.091 | 27.989 | 1.00 | 0.00 | XXXX | 1245 |
| ATOM | 1246 | CG | TYR A | 173 | −37.871 | 42.799 | 26.507 | 1.00 | 0.00 | XXXX | 1246 |
| ATOM | 1247 | CD1 | TYR A | 173 | −38.734 | 43.446 | 25.632 | 1.00 | 0.00 | XXXX | 1247 |
| ATOM | 1248 | CD2 | TYR A | 173 | −36.972 | 41.880 | 25.982 | 1.00 | 0.00 | XXXX | 1248 |
| ATOM | 1249 | CE1 | TYR A | 173 | −38.704 | 43.186 | 24.277 | 1.00 | 0.00 | XXXX | 1249 |
| ATOM | 1250 | CE2 | TYR A | 173 | −36.936 | 41.612 | 24.626 | 1.00 | 0.00 | XXXX | 1250 |
| ATOM | 1251 | CZ | TYR A | 173 | −37.804 | 42.269 | 23.779 | 1.00 | 0.00 | XXXX | 1251 |
| ATOM | 1252 | OH | TYR A | 173 | −37.772 | 42.009 | 22.429 | 1.00 | 0.00 | XXXX | 1252 |
| ATOM | 1253 | N | LEU A | 174 | −38.147 | 40.175 | 29.212 | 1.00 | 0.00 | XXXX | 1253 |
| ATOM | 1254 | CA | LEU A | 174 | −37.934 | 38.747 | 28.986 | 1.00 | 0.00 | XXXX | 1254 |
| ATOM | 1255 | C | LEU A | 174 | −39.021 | 37.886 | 29.621 | 1.00 | 0.00 | XXXX | 1255 |
| ATOM | 1256 | O | LEU A | 174 | −39.348 | 36.813 | 29.113 | 1.00 | 0.00 | XXXX | 1256 |
| ATOM | 1257 | CB | LEU A | 174 | −36.564 | 38.322 | 29.521 | 1.00 | 0.00 | XXXX | 1257 |
| ATOM | 1258 | CG | LEU A | 174 | −35.344 | 38.879 | 28.784 | 1.00 | 0.00 | XXXX | 1258 |
| ATOM | 1259 | CD1 | LEU A | 174 | −34.069 | 38.615 | 29.575 | 1.00 | 0.00 | XXXX | 1259 |
| ATOM | 1260 | CD2 | LEU A | 174 | −35.246 | 38.285 | 27.387 | 1.00 | 0.00 | XXXX | 1260 |
| ATOM | 1261 | N | GLY A | 175 | −39.574 | 38.355 | 30.734 | 1.00 | 0.00 | XXXX | 1261 |
| ATOM | 1262 | CA | GLY A | 175 | −40.586 | 37.602 | 31.451 | 1.00 | 0.00 | XXXX | 1262 |
| ATOM | 1263 | C | GLY A | 175 | −40.095 | 37.078 | 32.788 | 1.00 | 0.00 | XXXX | 1263 |
| ATOM | 1264 | O | GLY A | 175 | −40.703 | 36.182 | 33.374 | 1.00 | 0.00 | XXXX | 1264 |
| ATOM | 1265 | N | GLY A | 176 | −38.988 | 37.636 | 33.268 | 1.00 | 0.00 | XXXX | 1265 |
| ATOM | 1266 | CA | GLY A | 176 | −38.481 | 37.303 | 34.586 | 1.00 | 0.00 | XXXX | 1266 |
| ATOM | 1267 | C | GLY A | 176 | −38.893 | 38.361 | 35.588 | 1.00 | 0.00 | XXXX | 1267 |
| ATOM | 1268 | O | GLY A | 176 | −39.468 | 39.383 | 35.213 | 1.00 | 0.00 | XXXX | 1268 |
| ATOM | 1269 | N | VAL A | 177 | −38.602 | 38.125 | 36.863 | 1.00 | 0.00 | XXXX | 1269 |
| ATOM | 1270 | CA | VAL A | 177 | −38.957 | 39.085 | 37.902 | 1.00 | 0.00 | XXXX | 1270 |
| ATOM | 1271 | C | VAL A | 177 | −37.850 | 39.249 | 38.936 | 1.00 | 0.00 | XXXX | 1271 |
| ATOM | 1272 | O | VAL A | 177 | −36.976 | 38.393 | 39.075 | 1.00 | 0.00 | XXXX | 1272 |
| ATOM | 1273 | CB | VAL A | 177 | −40.251 | 38.678 | 38.630 | 1.00 | 0.00 | XXXX | 1273 |
| ATOM | 1274 | CG1 | VAL A | 177 | −41.443 | 38.752 | 37.683 | 1.00 | 0.00 | XXXX | 1274 |
| ATOM | 1275 | CG2 | VAL A | 177 | −40.110 | 37.283 | 39.221 | 1.00 | 0.00 | XXXX | 1275 |
| ATOM | 1276 | N | VAL A | 178 | −37.900 | 40.360 | 39.661 | 1.00 | 0.00 | XXXX | 1276 |
| ATOM | 1277 | CA | VAL A | 178 | −36.999 | 40.592 | 40.780 | 1.00 | 0.00 | XXXX | 1277 |
| ATOM | 1278 | C | VAL A | 178 | −37.742 | 40.296 | 42.075 | 1.00 | 0.00 | XXXX | 1278 |
| ATOM | 1279 | O | VAL A | 178 | −38.820 | 40.839 | 42.315 | 1.00 | 0.00 | XXXX | 1279 |
| ATOM | 1280 | CB | VAL A | 178 | −36.470 | 42.036 | 40.797 | 1.00 | 0.00 | XXXX | 1280 |
| ATOM | 1281 | CG1 | VAL A | 178 | −35.695 | 42.307 | 42.080 | 1.00 | 0.00 | XXXX | 1281 |
| ATOM | 1282 | CG2 | VAL A | 178 | −35.600 | 42.295 | 39.577 | 1.00 | 0.00 | XXXX | 1282 |
| ATOM | 1283 | N | VAL A | 179 | −37.169 | 39.431 | 42.906 | 1.00 | 0.00 | XXXX | 1283 |
| ATOM | 1284 | CA | VAL A | 179 | −37.821 | 39.022 | 44.144 | 1.00 | 0.00 | XXXX | 1284 |
| ATOM | 1285 | C | VAL A | 179 | −37.128 | 39.628 | 45.358 | 1.00 | 0.00 | XXXX | 1285 |
| ATOM | 1286 | O | VAL A | 179 | −37.495 | 39.350 | 46.500 | 1.00 | 0.00 | XXXX | 1286 |
| ATOM | 1287 | CB | VAL A | 179 | −37.844 | 37.489 | 44.287 | 1.00 | 0.00 | XXXX | 1287 |
| ATOM | 1288 | CG1 | VAL A | 179 | −38.704 | 36.867 | 43.194 | 1.00 | 0.00 | XXXX | 1288 |
| ATOM | 1289 | CG2 | VAL A | 179 | −36.426 | 36.931 | 44.246 | 1.00 | 0.00 | XXXX | 1289 |
| ATOM | 1290 | N | GLY A | 180 | −36.124 | 40.460 | 45.104 | 1.00 | 0.00 | XXXX | 1290 |
| ATOM | 1291 | CA | GLY A | 180 | −35.418 | 41.148 | 46.166 | 1.00 | 0.00 | XXXX | 1291 |
| ATOM | 1292 | C | GLY A | 180 | −34.399 | 42.124 | 45.617 | 1.00 | 0.00 | XXXX | 1292 |
| ATOM | 1293 | O | GLY A | 180 | −33.818 | 41.898 | 44.557 | 1.00 | 0.00 | XXXX | 1293 |
| ATOM | 1294 | N | GLU A | 181 | −34.177 | 43.211 | 46.346 | 1.00 | 0.00 | XXXX | 1294 |
| ATOM | 1295 | CA | GLU A | 181 | −33.239 | 44.242 | 45.920 | 1.00 | 0.00 | XXXX | 1295 |
| ATOM | 1296 | C | GLU A | 181 | −32.711 | 45.006 | 47.126 | 1.00 | 0.00 | XXXX | 1296 |
| ATOM | 1297 | O | GLU A | 181 | −33.470 | 45.666 | 47.831 | 1.00 | 0.00 | XXXX | 1297 |
| ATOM | 1298 | CB | GLU A | 181 | −33.905 | 45.200 | 44.929 | 1.00 | 0.00 | XXXX | 1298 |
| ATOM | 1299 | CG | GLU A | 181 | −33.012 | 46.340 | 44.463 | 1.00 | 0.00 | XXXX | 1299 |
| ATOM | 1300 | CD | GLU A | 181 | −33.714 | 47.264 | 43.487 | 1.00 | 0.00 | XXXX | 1300 |
| ATOM | 1301 | OE1 | GLU A | 181 | −34.924 | 47.068 | 43.251 | 1.00 | 0.00 | XXXX | 1301 |
| ATOM | 1302 | OE2 | GLU A | 181 | −33.057 | 48.183 | 42.954 | 1.00 | 0.00 | XXXX | 1302 |
| ATOM | 1303 | N | GLU A | 182 | −31.405 | 44.918 | 47.356 | 1.00 | 0.00 | XXXX | 1303 |
| ATOM | 1304 | CA | GLU A | 182 | −30.799 | 45.550 | 48.520 | 1.00 | 0.00 | XXXX | 1304 |
| ATOM | 1305 | C | GLU A | 182 | −29.478 | 46.221 | 48.170 | 1.00 | 0.00 | XXXX | 1305 |
| ATOM | 1306 | O | GLU A | 182 | −28.727 | 45.729 | 47.328 | 1.00 | 0.00 | XXXX | 1306 |

-continued

| | | | | | | | | | | |
|---|---|---|---|---|---|---|---|---|---|---|
| ATOM | 1307 | CB | GLU A | 182 | −30.579 | 44.523 | 49.633 | 1.00 | 0.00 XXXX | 1307 |
| ATOM | 1308 | CG | GLU A | 182 | −31.856 | 43.886 | 50.153 | 1.00 | 0.00 XXXX | 1308 |
| ATOM | 1309 | CD | GLU A | 182 | −32.691 | 44.847 | 50.974 | 1.00 | 0.00 XXXX | 1309 |
| ATOM | 1310 | OE1 | GLU A | 182 | −32.103 | 45.688 | 51.686 | 1.00 | 0.00 XXXX | 1310 |
| ATOM | 1311 | OE2 | GLU A | 182 | −33.937 | 44.760 | 50.910 | 1.00 | 0.00 XXXX | 1311 |
| ATOM | 1312 | N | TYR A | 183 | −29.204 | 47.347 | 48.820 | 1.00 | 0.00 XXXX | 1312 |
| ATOM | 1313 | CA | TYR A | 183 | −27.940 | 48.048 | 48.639 | 1.00 | 0.00 XXXX | 1313 |
| ATOM | 1314 | C | TYR A | 183 | −27.223 | 48.239 | 49.968 | 1.00 | 0.00 XXXX | 1314 |
| ATOM | 1315 | O | TYR A | 183 | −27.851 | 48.493 | 50.996 | 1.00 | 0.00 XXXX | 1315 |
| ATOM | 1316 | CB | TYR A | 183 | −28.165 | 49.405 | 47.969 | 1.00 | 0.00 XXXX | 1316 |
| ATOM | 1317 | CG | TYR A | 183 | −28.814 | 49.307 | 46.610 | 1.00 | 0.00 XXXX | 1317 |
| ATOM | 1318 | CD1 | TYR A | 183 | −30.195 | 49.357 | 46.473 | 1.00 | 0.00 XXXX | 1318 |
| ATOM | 1319 | CD2 | TYR A | 183 | −28.047 | 49.154 | 45.462 | 1.00 | 0.00 XXXX | 1319 |
| ATOM | 1320 | CE1 | TYR A | 183 | −30.793 | 49.260 | 45.232 | 1.00 | 0.00 XXXX | 1320 |
| ATOM | 1321 | CE2 | TYR A | 183 | −28.637 | 49.057 | 44.217 | 1.00 | 0.00 XXXX | 1321 |
| ATOM | 1322 | CZ | TYR A | 183 | −30.009 | 49.112 | 44.108 | 1.00 | 0.00 XXXX | 1322 |
| ATOM | 1323 | OH | TYR A | 183 | −30.599 | 49.015 | 42.869 | 1.00 | 0.00 XXXX | 1323 |
| ATOM | 1324 | N | THR A | 184 | −25.903 | 48.115 | 49.940 | 1.00 | 0.00 XXXX | 1324 |
| ATOM | 1325 | CA | THR A | 184 | −25.085 | 48.409 | 51.104 | 1.00 | 0.00 XXXX | 1325 |
| ATOM | 1326 | C | THR A | 184 | −24.048 | 49.459 | 50.737 | 1.00 | 0.00 XXXX | 1326 |
| ATOM | 1327 | O | THR A | 184 | −23.561 | 49.480 | 49.606 | 1.00 | 0.00 XXXX | 1327 |
| ATOM | 1328 | CB | THR A | 184 | −24.380 | 47.148 | 51.641 | 1.00 | 0.00 XXXX | 1328 |
| ATOM | 1329 | OG1 | THR A | 184 | −23.593 | 46.559 | 50.598 | 1.00 | 0.00 XXXX | 1329 |
| ATOM | 1330 | CG2 | THR A | 184 | −25.400 | 46.131 | 52.130 | 1.00 | 0.00 XXXX | 1330 |
| ATOM | 1331 | N | PRO A | 185 | −23.719 | 50.346 | 51.686 | 1.00 | 0.00 XXXX | 1331 |
| ATOM | 1332 | CA | PRO A | 185 | −22.670 | 51.344 | 51.460 | 1.00 | 0.00 XXXX | 1332 |
| ATOM | 1333 | C | PRO A | 185 | −21.361 | 50.672 | 51.063 | 1.00 | 0.00 XXXX | 1333 |
| ATOM | 1334 | O | PRO A | 185 | −21.093 | 49.562 | 51.524 | 1.00 | 0.00 XXXX | 1334 |
| ATOM | 1335 | CB | PRO A | 185 | −22.544 | 52.039 | 52.820 | 1.00 | 0.00 XXXX | 1335 |
| ATOM | 1336 | CG | PRO A | 185 | −23.873 | 51.833 | 53.469 | 1.00 | 0.00 XXXX | 1336 |
| ATOM | 1337 | CD | PRO A | 185 | −24.328 | 50.476 | 53.021 | 1.00 | 0.00 XXXX | 1337 |
| ATOM | 1338 | N | LEU A | 186 | −20.583 | 51.311 | 50.195 | 1.00 | 0.00 XXXX | 1338 |
| ATOM | 1339 | CA | LEU A | 186 | −19.249 | 50.817 | 49.878 | 1.00 | 0.00 XXXX | 1339 |
| ATOM | 1340 | C | LEU A | 186 | −18.465 | 50.590 | 51.166 | 1.00 | 0.00 XXXX | 1340 |
| ATOM | 1341 | O | LEU A | 186 | −18.440 | 51.452 | 52.042 | 1.00 | 0.00 XXXX | 1341 |
| ATOM | 1342 | CB | LEU A | 186 | −18.508 | 51.795 | 48.964 | 1.00 | 0.00 XXXX | 1342 |
| ATOM | 1343 | CG | LEU A | 186 | −18.821 | 51.705 | 47.469 | 1.00 | 0.00 XXXX | 1343 |
| ATOM | 1344 | CD1 | LEU A | 186 | −18.272 | 52.919 | 46.738 | 1.00 | 0.00 XXXX | 1344 |
| ATOM | 1345 | CD2 | LEU A | 186 | −18.260 | 50.421 | 46.876 | 1.00 | 0.00 XXXX | 1345 |
| ATOM | 1346 | N | GLY A | 187 | −17.831 | 49.427 | 51.278 | 1.00 | 0.00 XXXX | 1346 |
| ATOM | 1347 | CA | GLY A | 187 | −17.035 | 49.111 | 52.448 | 1.00 | 0.00 XXXX | 1347 |
| ATOM | 1348 | C | GLY A | 187 | −17.803 | 48.394 | 53.544 | 1.00 | 0.00 XXXX | 1348 |
| ATOM | 1349 | O | GLY A | 187 | −17.214 | 47.970 | 54.540 | 1.00 | 0.00 XXXX | 1349 |
| ATOM | 1350 | N | HIS A | 188 | −19.115 | 48.261 | 53.366 | 1.00 | 0.00 XXXX | 1350 |
| ATOM | 1351 | CA | HIS A | 188 | −19.958 | 47.517 | 54.303 | 1.00 | 0.00 XXXX | 1351 |
| ATOM | 1352 | C | HIS A | 188 | −19.427 | 46.098 | 54.501 | 1.00 | 0.00 XXXX | 1352 |
| ATOM | 1353 | O | HIS A | 188 | −18.920 | 45.487 | 53.560 | 1.00 | 0.00 XXXX | 1353 |
| ATOM | 1354 | CB | HIS A | 188 | −21.403 | 47.482 | 53.798 | 1.00 | 0.00 XXXX | 1354 |
| ATOM | 1355 | CG | HIS A | 188 | −22.406 | 47.116 | 54.848 | 1.00 | 0.00 XXXX | 1355 |
| ATOM | 1356 | ND1 | HIS A | 188 | −22.852 | 48.013 | 55.795 | 1.00 | 0.00 XXXX | 1356 |
| ATOM | 1357 | CD2 | HIS A | 188 | −23.059 | 45.956 | 55.092 | 1.00 | 0.00 XXXX | 1357 |
| ATOM | 1358 | CE1 | HIS A | 188 | −23.731 | 47.419 | 56.581 | 1.00 | 0.00 XXXX | 1358 |
| ATOM | 1359 | NE2 | HIS A | 188 | −23.877 | 46.171 | 56.176 | 1.00 | 0.00 XXXX | 1359 |
| ATOM | 1360 | N | THR A | 189 | −19.545 | 45.573 | 55.718 | 1.00 | 0.00 XXXX | 1360 |
| ATOM | 1361 | CA | THR A | 189 | −18.996 | 44.252 | 56.017 | 1.00 | 0.00 XXXX | 1361 |
| ATOM | 1362 | C | THR A | 189 | −19.981 | 43.292 | 56.690 | 1.00 | 0.00 XXXX | 1362 |
| ATOM | 1363 | O | THR A | 189 | −19.711 | 42.095 | 56.787 | 1.00 | 0.00 XXXX | 1363 |
| ATOM | 1364 | CB | THR A | 189 | −17.753 | 44.369 | 56.922 | 1.00 | 0.00 XXXX | 1364 |
| ATOM | 1365 | OG1 | THR A | 189 | −18.126 | 44.954 | 58.176 | 1.00 | 0.00 XXXX | 1365 |
| ATOM | 1366 | CG2 | THR A | 189 | −16.691 | 45.235 | 56.258 | 1.00 | 0.00 XXXX | 1366 |
| ATOM | 1367 | N | ASP A | 190 | −21.116 | 43.809 | 57.151 | 1.00 | 0.00 XXXX | 1367 |
| ATOM | 1368 | CA | ASP A | 190 | −22.108 | 42.972 | 57.826 | 1.00 | 0.00 XXXX | 1368 |
| ATOM | 1369 | C | ASP A | 190 | −23.235 | 42.582 | 56.873 | 1.00 | 0.00 XXXX | 1369 |
| ATOM | 1370 | O | ASP A | 190 | −24.123 | 43.386 | 56.587 | 1.00 | 0.00 XXXX | 1370 |
| ATOM | 1371 | CB | ASP A | 190 | −22.681 | 43.688 | 59.050 | 1.00 | 0.00 XXXX | 1371 |
| ATOM | 1372 | CG | ASP A | 190 | −23.536 | 42.776 | 59.918 | 1.00 | 0.00 XXXX | 1372 |
| ATOM | 1373 | OD1 | ASP A | 190 | −23.762 | 41.608 | 59.532 | 1.00 | 0.00 XXXX | 1373 |
| ATOM | 1374 | OD2 | ASP A | 190 | −23.991 | 43.233 | 60.986 | 1.00 | 0.00 XXXX | 1374 |
| ATOM | 1375 | N | TYR A | 191 | −23.195 | 41.347 | 56.386 | 1.00 | 0.00 XXXX | 1375 |
| ATOM | 1376 | CA | TYR A | 191 | −24.180 | 40.877 | 55.418 | 1.00 | 0.00 XXXX | 1376 |
| ATOM | 1377 | C | TYR A | 191 | −25.126 | 39.821 | 55.987 | 1.00 | 0.00 XXXX | 1377 |
| ATOM | 1378 | O | TYR A | 191 | −25.791 | 39.106 | 55.241 | 1.00 | 0.00 XXXX | 1378 |
| ATOM | 1379 | CB | TYR A | 191 | −23.466 | 40.357 | 54.170 | 1.00 | 0.00 XXXX | 1379 |
| ATOM | 1380 | CG | TYR A | 191 | −22.927 | 41.497 | 53.342 | 1.00 | 0.00 XXXX | 1380 |
| ATOM | 1381 | CD1 | TYR A | 191 | −23.714 | 42.109 | 52.377 | 1.00 | 0.00 XXXX | 1381 |
| ATOM | 1382 | CD2 | TYR A | 191 | −21.651 | 41.999 | 53.563 | 1.00 | 0.00 XXXX | 1382 |
| ATOM | 1383 | CE1 | TYR A | 191 | −23.238 | 43.170 | 51.635 | 1.00 | 0.00 XXXX | 1383 |
| ATOM | 1384 | CE2 | TYR A | 191 | −21.164 | 43.059 | 52.826 | 1.00 | 0.00 XXXX | 1384 |
| ATOM | 1385 | CZ | TYR A | 191 | −21.963 | 43.641 | 51.863 | 1.00 | 0.00 XXXX | 1385 |

-continued

| | | | | | | | | | | |
|---|---|---|---|---|---|---|---|---|---|---|
| ATOM | 1386 | OH | TYR A | 191 | −21.483 | 44.698 | 51.127 | 1.00 | 0.00 XXXX | 1386 |
| ATOM | 1387 | N | SER A | 192 | −25.179 | 39.728 | 57.312 | 1.00 | 0.00 XXXX | 1387 |
| ATOM | 1388 | CA | SER A | 192 | −26.072 | 38.784 | 57.973 | 1.00 | 0.00 XXXX | 1388 |
| ATOM | 1389 | C | SER A | 192 | −27.533 | 39.073 | 57.630 | 1.00 | 0.00 XXXX | 1389 |
| ATOM | 1390 | O | SER A | 192 | −28.317 | 38.156 | 57.386 | 1.00 | 0.00 XXXX | 1390 |
| ATOM | 1391 | CB | SER A | 192 | −25.867 | 38.824 | 59.488 | 1.00 | 0.00 XXXX | 1391 |
| ATOM | 1392 | OG | SER A | 192 | −26.150 | 40.111 | 60.007 | 1.00 | 0.00 XXXX | 1392 |
| ATOM | 1393 | N | SER A | 193 | −27.892 | 40.353 | 57.612 | 1.00 | 0.00 XXXX | 1393 |
| ATOM | 1394 | CA | SER A | 193 | −29.260 | 40.764 | 57.311 | 1.00 | 0.00 XXXX | 1394 |
| ATOM | 1395 | C | SER A | 193 | −29.665 | 40.435 | 55.874 | 1.00 | 0.00 XXXX | 1395 |
| ATOM | 1396 | O | SER A | 193 | −30.726 | 39.855 | 55.637 | 1.00 | 0.00 XXXX | 1396 |
| ATOM | 1397 | CB | SER A | 193 | −29.432 | 42.262 | 57.563 | 1.00 | 0.00 XXXX | 1397 |
| ATOM | 1398 | OG | SER A | 193 | −30.666 | 42.724 | 57.041 | 1.00 | 0.00 XXXX | 1398 |
| ATOM | 1399 | N | VAL A | 194 | −28.816 | 40.813 | 54.923 | 1.00 | 0.00 XXXX | 1399 |
| ATOM | 1400 | CA | VAL A | 194 | −29.044 | 40.507 | 53.514 | 1.00 | 0.00 XXXX | 1400 |
| ATOM | 1401 | C | VAL A | 194 | −29.166 | 39.006 | 53.267 | 1.00 | 0.00 XXXX | 1401 |
| ATOM | 1402 | O | VAL A | 194 | −30.076 | 38.554 | 52.573 | 1.00 | 0.00 XXXX | 1402 |
| ATOM | 1403 | CB | VAL A | 194 | −27.912 | 41.061 | 52.625 | 1.00 | 0.00 XXXX | 1403 |
| ATOM | 1404 | CG1 | VAL A | 194 | −27.969 | 40.429 | 51.243 | 1.00 | 0.00 XXXX | 1404 |
| ATOM | 1405 | CG2 | VAL A | 194 | −27.996 | 42.578 | 52.532 | 1.00 | 0.00 XXXX | 1405 |
| ATOM | 1406 | N | ILE A | 195 | −28.243 | 38.238 | 53.837 | 1.00 | 0.00 XXXX | 1406 |
| ATOM | 1407 | CA | ILE A | 195 | −28.229 | 36.793 | 53.641 | 1.00 | 0.00 XXXX | 1407 |
| ATOM | 1408 | C | ILE A | 195 | −29.473 | 36.136 | 54.237 | 1.00 | 0.00 XXXX | 1408 |
| ATOM | 1409 | O | ILE A | 195 | −30.016 | 35.191 | 53.664 | 1.00 | 0.00 XXXX | 1409 |
| ATOM | 1410 | CB | ILE A | 195 | −26.965 | 36.159 | 54.251 | 1.00 | 0.00 XXXX | 1410 |
| ATOM | 1411 | CG1 | ILE A | 195 | −25.735 | 36.547 | 53.426 | 1.00 | 0.00 XXXX | 1411 |
| ATOM | 1412 | CG2 | ILE A | 195 | −27.105 | 34.645 | 54.317 | 1.00 | 0.00 XXXX | 1412 |
| ATOM | 1413 | CD1 | ILE A | 195 | −24.418 | 36.245 | 54.110 | 1.00 | 0.00 XXXX | 1413 |
| ATOM | 1414 | N | ASN A | 196 | −29.926 | 36.636 | 55.383 | 1.00 | 0.00 XXXX | 1414 |
| ATOM | 1415 | CA | ASN A | 196 | −31.165 | 36.144 | 55.978 | 1.00 | 0.00 XXXX | 1415 |
| ATOM | 1416 | C | ASN A | 196 | −32.370 | 36.409 | 55.078 | 1.00 | 0.00 XXXX | 1416 |
| ATOM | 1417 | O | ASN A | 196 | −33.265 | 35.569 | 54.965 | 1.00 | 0.00 XXXX | 1417 |
| ATOM | 1418 | CB | ASN A | 196 | −31.395 | 36.773 | 57.354 | 1.00 | 0.00 XXXX | 1418 |
| ATOM | 1419 | CG | ASN A | 196 | −30.561 | 36.120 | 58.441 | 1.00 | 0.00 XXXX | 1419 |
| ATOM | 1420 | OD1 | ASN A | 196 | −30.098 | 34.989 | 58.293 | 1.00 | 0.00 XXXX | 1420 |
| ATOM | 1421 | ND2 | ASN A | 196 | −30.374 | 36.830 | 59.547 | 1.00 | 0.00 XXXX | 1421 |
| ATOM | 1422 | N | LYS A | 197 | −32.392 | 37.577 | 54.444 | 1.00 | 0.00 XXXX | 1422 |
| ATOM | 1423 | CA | LYS A | 197 | −33.455 | 37.910 | 53.500 | 1.00 | 0.00 XXXX | 1423 |
| ATOM | 1424 | C | LYS A | 197 | −33.392 | 37.007 | 52.274 | 1.00 | 0.00 XXXX | 1424 |
| ATOM | 1425 | O | LYS A | 197 | −34.420 | 36.546 | 51.777 | 1.00 | 0.00 XXXX | 1425 |
| ATOM | 1426 | CB | LYS A | 197 | −33.371 | 39.376 | 53.069 | 1.00 | 0.00 XXXX | 1426 |
| ATOM | 1427 | CG | LYS A | 197 | −33.734 | 40.378 | 54.149 | 1.00 | 0.00 XXXX | 1427 |
| ATOM | 1428 | CD | LYS A | 197 | −33.554 | 41.799 | 53.643 | 1.00 | 0.00 XXXX | 1428 |
| ATOM | 1429 | CE | LYS A | 197 | −33.879 | 42.821 | 54.718 | 1.00 | 0.00 XXXX | 1429 |
| ATOM | 1430 | NZ | LYS A | 197 | −33.574 | 44.207 | 54.268 | 1.00 | 0.00 XXXX | 1430 |
| ATOM | 1431 | N | ILE A | 198 | −32.179 | 36.768 | 51.786 | 1.00 | 0.00 XXXX | 1431 |
| ATOM | 1432 | CA | ILE A | 198 | −31.969 | 35.875 | 50.654 | 1.00 | 0.00 XXXX | 1432 |
| ATOM | 1433 | C | ILE A | 198 | −32.446 | 34.464 | 50.984 | 1.00 | 0.00 XXXX | 1433 |
| ATOM | 1434 | O | ILE A | 198 | −33.108 | 33.819 | 50.171 | 1.00 | 0.00 XXXX | 1434 |
| ATOM | 1435 | CB | ILE A | 198 | −30.489 | 35.839 | 50.231 | 1.00 | 0.00 XXXX | 1435 |
| ATOM | 1436 | CG1 | ILE A | 198 | −30.079 | 37.185 | 49.630 | 1.00 | 0.00 XXXX | 1436 |
| ATOM | 1437 | CG2 | ILE A | 198 | −30.247 | 34.714 | 49.236 | 1.00 | 0.00 XXXX | 1437 |
| ATOM | 1438 | CD1 | ILE A | 198 | −28.617 | 37.267 | 49.245 | 1.00 | 0.00 XXXX | 1438 |
| ATOM | 1439 | N | LYS A | 199 | −32.106 | 33.989 | 52.179 | 1.00 | 0.00 XXXX | 1439 |
| ATOM | 1440 | CA | LYS A | 199 | −32.557 | 32.680 | 52.640 | 1.00 | 0.00 XXXX | 1440 |
| ATOM | 1441 | C | LYS A | 199 | −34.081 | 32.581 | 52.640 | 1.00 | 0.00 XXXX | 1441 |
| ATOM | 1442 | O | LYS A | 199 | −34.644 | 31.534 | 52.317 | 1.00 | 0.00 XXXX | 1442 |
| ATOM | 1443 | CB | LYS A | 199 | −32.017 | 32.383 | 54.042 | 1.00 | 0.00 XXXX | 1443 |
| ATOM | 1444 | CG | LYS A | 199 | −30.557 | 31.965 | 54.076 | 1.00 | 0.00 XXXX | 1444 |
| ATOM | 1445 | CD | LYS A | 199 | −30.125 | 31.591 | 55.486 | 1.00 | 0.00 XXXX | 1445 |
| ATOM | 1446 | CE | LYS A | 199 | −28.680 | 31.123 | 55.514 | 1.00 | 0.00 XXXX | 1446 |
| ATOM | 1447 | NZ | LYS A | 199 | −28.275 | 30.652 | 56.868 | 1.00 | 0.00 XXXX | 1447 |
| ATOM | 1448 | N | ALA A | 200 | −34.743 | 33.673 | 53.007 | 1.00 | 0.00 XXXX | 1448 |
| ATOM | 1449 | CA | ALA A | 200 | −36.200 | 33.693 | 53.077 | 1.00 | 0.00 XXXX | 1449 |
| ATOM | 1450 | C | ALA A | 200 | −36.829 | 33.817 | 51.692 | 1.00 | 0.00 XXXX | 1450 |
| ATOM | 1451 | O | ALA A | 200 | −37.873 | 33.228 | 51.420 | 1.00 | 0.00 XXXX | 1451 |
| ATOM | 1452 | CB | ALA A | 200 | −36.670 | 34.830 | 53.977 | 1.00 | 0.00 XXXX | 1452 |
| ATOM | 1453 | N | ALA A | 201 | −36.186 | 34.584 | 50.818 | 1.00 | 0.00 XXXX | 1453 |
| ATOM | 1454 | CA | ALA A | 201 | −36.736 | 34.848 | 49.493 | 1.00 | 0.00 XXXX | 1454 |
| ATOM | 1455 | C | ALA A | 201 | −36.549 | 33.662 | 48.549 | 1.00 | 0.00 XXXX | 1455 |
| ATOM | 1456 | O | ALA A | 201 | −37.353 | 33.455 | 47.640 | 1.00 | 0.00 XXXX | 1456 |
| ATOM | 1457 | CB | ALA A | 201 | −36.101 | 36.096 | 48.903 | 1.00 | 0.00 XXXX | 1457 |
| ATOM | 1458 | N | LYS A | 202 | −35.492 | 32.887 | 48.776 | 1.00 | 0.00 XXXX | 1458 |
| ATOM | 1459 | CA | LYS A | 202 | −35.171 | 31.729 | 47.942 | 1.00 | 0.00 XXXX | 1459 |
| ATOM | 1460 | C | LYS A | 202 | −35.152 | 32.057 | 46.448 | 1.00 | 0.00 XXXX | 1460 |
| ATOM | 1461 | O | LYS A | 202 | −35.895 | 31.460 | 45.668 | 1.00 | 0.00 XXXX | 1461 |
| ATOM | 1462 | CB | LYS A | 202 | −36.166 | 30.596 | 48.210 | 1.00 | 0.00 XXXX | 1462 |
| ATOM | 1463 | CG | LYS A | 202 | −36.115 | 30.050 | 49.628 | 1.00 | 0.00 XXXX | 1463 |
| ATOM | 1464 | CD | LYS A | 202 | −37.124 | 28.932 | 49.831 | 1.00 | 0.00 XXXX | 1464 |

-continued

| | | | | | | | | | | |
|---|---|---|---|---|---|---|---|---|---|---|
| ATOM | 1465 | CE | LYS A | 202 | −36.958 | 28.282 | 51.195 | 1.00 | 0.00 | XXXX | 1465 |
| ATOM | 1466 | NZ | LYS A | 202 | −38.001 | 27.250 | 51.455 | 1.00 | 0.00 | XXXX | 1466 |
| ATOM | 1467 | N | PRO A | 203 | −34.296 | 33.009 | 46.043 | 1.00 | 0.00 | XXXX | 1467 |
| ATOM | 1468 | CA | PRO A | 203 | −34.179 | 33.385 | 44.630 | 1.00 | 0.00 | XXXX | 1468 |
| ATOM | 1469 | C | PRO A | 203 | −33.510 | 32.300 | 43.789 | 1.00 | 0.00 | XXXX | 1469 |
| ATOM | 1470 | O | PRO A | 203 | −32.888 | 31.395 | 44.345 | 1.00 | 0.00 | XXXX | 1470 |
| ATOM | 1471 | CB | PRO A | 203 | −33.314 | 34.646 | 44.682 | 1.00 | 0.00 | XXXX | 1471 |
| ATOM | 1472 | CG | PRO A | 203 | −32.459 | 34.442 | 45.891 | 1.00 | 0.00 | XXXX | 1472 |
| ATOM | 1473 | CD | PRO A | 203 | −33.360 | 33.767 | 46.893 | 1.00 | 0.00 | XXXX | 1473 |
| ATOM | 1474 | N | ASP A | 204 | −33.638 | 32.394 | 42.468 | 1.00 | 0.00 | XXXX | 1474 |
| ATOM | 1475 | CA | ASP A | 204 | −32.958 | 31.469 | 41.567 | 1.00 | 0.00 | XXXX | 1475 |
| ATOM | 1476 | C | ASP A | 204 | −31.492 | 31.849 | 41.428 | 1.00 | 0.00 | XXXX | 1476 |
| ATOM | 1477 | O | ASP A | 204 | −30.628 | 30.994 | 41.235 | 1.00 | 0.00 | XXXX | 1477 |
| ATOM | 1478 | CB | ASP A | 204 | −33.616 | 31.464 | 40.184 | 1.00 | 0.00 | XXXX | 1478 |
| ATOM | 1479 | CG | ASP A | 204 | −35.070 | 31.051 | 40.228 | 1.00 | 0.00 | XXXX | 1479 |
| ATOM | 1480 | OD1 | ASP A | 204 | −35.478 | 30.408 | 41.217 | 1.00 | 0.00 | XXXX | 1480 |
| ATOM | 1481 | OD2 | ASP A | 204 | −35.801 | 31.363 | 39.265 | 1.00 | 0.00 | XXXX | 1481 |
| ATOM | 1482 | N | VAL A | 205 | −31.226 | 33.145 | 41.529 | 1.00 | 0.00 | XXXX | 1482 |
| ATOM | 1483 | CA | VAL A | 205 | −29.891 | 33.677 | 41.304 | 1.00 | 0.00 | XXXX | 1483 |
| ATOM | 1484 | C | VAL A | 205 | −29.722 | 35.024 | 41.991 | 1.00 | 0.00 | XXXX | 1484 |
| ATOM | 1485 | O | VAL A | 205 | −30.671 | 35.802 | 42.105 | 1.00 | 0.00 | XXXX | 1485 |
| ATOM | 1486 | CB | VAL A | 205 | −29.596 | 33.837 | 39.797 | 1.00 | 0.00 | XXXX | 1486 |
| ATOM | 1487 | CG1 | VAL A | 205 | −30.544 | 34.853 | 39.178 | 1.00 | 0.00 | XXXX | 1487 |
| ATOM | 1488 | CG2 | VAL A | 205 | −28.145 | 34.242 | 39.568 | 1.00 | 0.00 | XXXX | 1488 |
| ATOM | 1489 | N | VAL A | 206 | −28.511 | 35.286 | 42.467 | 1.00 | 0.00 | XXXX | 1489 |
| ATOM | 1490 | CA | VAL A | 206 | −28.160 | 36.606 | 42.963 | 1.00 | 0.00 | XXXX | 1490 |
| ATOM | 1491 | C | VAL A | 206 | −27.350 | 37.345 | 41.908 | 1.00 | 0.00 | XXXX | 1491 |
| ATOM | 1492 | O | VAL A | 206 | −26.337 | 36.837 | 41.429 | 1.00 | 0.00 | XXXX | 1492 |
| ATOM | 1493 | CB | VAL A | 206 | −27.349 | 36.533 | 44.270 | 1.00 | 0.00 | XXXX | 1493 |
| ATOM | 1494 | CG1 | VAL A | 206 | −26.982 | 37.933 | 44.739 | 1.00 | 0.00 | XXXX | 1494 |
| ATOM | 1495 | CG2 | VAL A | 206 | −28.132 | 35.793 | 45.342 | 1.00 | 0.00 | XXXX | 1495 |
| ATOM | 1496 | N | PHE A | 207 | −27.797 | 38.539 | 41.534 | 1.00 | 0.00 | XXXX | 1496 |
| ATOM | 1497 | CA | PHE A | 207 | −27.009 | 39.357 | 40.625 | 1.00 | 0.00 | XXXX | 1497 |
| ATOM | 1498 | C | PHE A | 207 | −26.241 | 40.378 | 41.450 | 1.00 | 0.00 | XXXX | 1498 |
| ATOM | 1499 | O | PHE A | 207 | −26.816 | 41.326 | 41.986 | 1.00 | 0.00 | XXXX | 1499 |
| ATOM | 1500 | CB | PHE A | 207 | −27.885 | 40.045 | 39.575 | 1.00 | 0.00 | XXXX | 1500 |
| ATOM | 1501 | CG | PHE A | 207 | −27.139 | 40.407 | 38.320 | 1.00 | 0.00 | XXXX | 1501 |
| ATOM | 1502 | CD1 | PHE A | 207 | −26.220 | 41.443 | 38.319 | 1.00 | 0.00 | XXXX | 1502 |
| ATOM | 1503 | CD2 | PHE A | 207 | −27.341 | 39.697 | 37.148 | 1.00 | 0.00 | XXXX | 1503 |
| ATOM | 1504 | CE1 | PHE A | 207 | −25.520 | 41.770 | 37.169 | 1.00 | 0.00 | XXXX | 1504 |
| ATOM | 1505 | CE2 | PHE A | 207 | −26.648 | 40.021 | 35.993 | 1.00 | 0.00 | XXXX | 1505 |
| ATOM | 1506 | CZ | PHE A | 207 | −25.735 | 41.058 | 36.005 | 1.00 | 0.00 | XXXX | 1506 |
| ATOM | 1507 | N | ASN A | 208 | −24.933 | 40.168 | 41.543 | 1.00 | 0.00 | XXXX | 1507 |
| ATOM | 1508 | CA | ASN A | 208 | −24.085 | 40.925 | 42.454 | 1.00 | 0.00 | XXXX | 1508 |
| ATOM | 1509 | C | ASN A | 208 | −23.383 | 42.109 | 41.800 | 1.00 | 0.00 | XXXX | 1509 |
| ATOM | 1510 | O | ASN A | 208 | −22.557 | 41.936 | 40.903 | 1.00 | 0.00 | XXXX | 1510 |
| ATOM | 1511 | CB | ASN A | 208 | −23.041 | 39.996 | 43.077 | 1.00 | 0.00 | XXXX | 1511 |
| ATOM | 1512 | CG | ASN A | 208 | −22.045 | 40.738 | 43.942 | 1.00 | 0.00 | XXXX | 1512 |
| ATOM | 1513 | OD1 | ASN A | 208 | −22.389 | 41.716 | 44.604 | 1.00 | 0.00 | XXXX | 1513 |
| ATOM | 1514 | ND2 | ASN A | 208 | −20.799 | 40.277 | 43.940 | 1.00 | 0.00 | XXXX | 1514 |
| ATOM | 1515 | N | THR A | 209 | −23.715 | 43.312 | 42.258 | 1.00 | 0.00 | XXXX | 1515 |
| ATOM | 1516 | CA | THR A | 209 | −23.037 | 44.515 | 41.795 | 1.00 | 0.00 | XXXX | 1516 |
| ATOM | 1517 | C | THR A | 209 | −22.267 | 45.190 | 42.928 | 1.00 | 0.00 | XXXX | 1517 |
| ATOM | 1518 | O | THR A | 209 | −21.977 | 46.385 | 42.861 | 1.00 | 0.00 | XXXX | 1518 |
| ATOM | 1519 | CB | THR A | 209 | −24.024 | 45.526 | 41.177 | 1.00 | 0.00 | XXXX | 1519 |
| ATOM | 1520 | OG1 | THR A | 209 | −25.138 | 45.712 | 42.057 | 1.00 | 0.00 | XXXX | 1520 |
| ATOM | 1521 | CG2 | THR A | 209 | −24.529 | 45.024 | 39.831 | 1.00 | 0.00 | XXXX | 1521 |
| ATOM | 1522 | N | LEU A | 210 | −21.952 | 44.430 | 43.974 | 1.00 | 0.00 | XXXX | 1522 |
| ATOM | 1523 | CA | LEU A | 210 | −21.044 | 44.915 | 45.008 | 1.00 | 0.00 | XXXX | 1523 |
| ATOM | 1524 | C | LEU A | 210 | −19.693 | 45.262 | 44.394 | 1.00 | 0.00 | XXXX | 1524 |
| ATOM | 1525 | O | LEU A | 210 | −19.185 | 44.533 | 43.542 | 1.00 | 0.00 | XXXX | 1525 |
| ATOM | 1526 | CB | LEU A | 210 | −20.860 | 43.878 | 46.121 | 1.00 | 0.00 | XXXX | 1526 |
| ATOM | 1527 | CG | LEU A | 210 | −22.052 | 43.540 | 47.016 | 1.00 | 0.00 | XXXX | 1527 |
| ATOM | 1528 | CD1 | LEU A | 210 | −21.688 | 42.405 | 47.963 | 1.00 | 0.00 | XXXX | 1528 |
| ATOM | 1529 | CD2 | LEU A | 210 | −22.502 | 44.769 | 47.794 | 1.00 | 0.00 | XXXX | 1529 |
| ATOM | 1530 | N | ASN A | 211 | −19.122 | 46.380 | 44.828 | 1.00 | 0.00 | XXXX | 1530 |
| ATOM | 1531 | CA | ASN A | 211 | −17.793 | 46.792 | 44.396 | 1.00 | 0.00 | XXXX | 1531 |
| ATOM | 1532 | C | ASN A | 211 | −16.855 | 46.916 | 45.593 | 1.00 | 0.00 | XXXX | 1532 |
| ATOM | 1533 | O | ASN A | 211 | −17.280 | 47.291 | 46.684 | 1.00 | 0.00 | XXXX | 1533 |
| ATOM | 1534 | CB | ASN A | 211 | −17.861 | 48.118 | 43.634 | 1.00 | 0.00 | XXXX | 1534 |
| ATOM | 1535 | CG | ASN A | 211 | −18.240 | 47.936 | 42.175 | 1.00 | 0.00 | XXXX | 1535 |
| ATOM | 1536 | OD1 | ASN A | 211 | −17.417 | 48.133 | 41.280 | 1.00 | 0.00 | XXXX | 1536 |
| ATOM | 1537 | ND2 | ASN A | 211 | −19.492 | 47.565 | 41.927 | 1.00 | 0.00 | XXXX | 1537 |
| ATOM | 1538 | N | GLY A | 212 | −15.581 | 46.597 | 45.388 | 1.00 | 0.00 | XXXX | 1538 |
| ATOM | 1539 | CA | GLY A | 212 | −14.588 | 46.746 | 46.438 | 1.00 | 0.00 | XXXX | 1539 |
| ATOM | 1540 | C | GLY A | 212 | −14.615 | 45.604 | 47.437 | 1.00 | 0.00 | XXXX | 1540 |
| ATOM | 1541 | O | GLY A | 212 | −15.196 | 44.553 | 47.171 | 1.00 | 0.00 | XXXX | 1541 |
| ATOM | 1542 | N | ASP A | 213 | −13.988 | 45.806 | 48.592 | 1.00 | 0.00 | XXXX | 1542 |
| ATOM | 1543 | CA | ASP A | 213 | −13.773 | 44.708 | 49.527 | 1.00 | 0.00 | XXXX | 1543 |

-continued

| | | | | | | | | | | |
|---|---|---|---|---|---|---|---|---|---|---|
| ATOM | 1544 | C | ASP A | 213 | −15.024 | 44.338 | 50.328 | 1.00 | 0.00 | XXXX | 1544 |
| ATOM | 1545 | O | ASP A | 213 | −14.963 | 43.487 | 51.215 | 1.00 | 0.00 | XXXX | 1545 |
| ATOM | 1546 | CB | ASP A | 213 | −12.606 | 45.028 | 50.474 | 1.00 | 0.00 | XXXX | 1546 |
| ATOM | 1547 | CG | ASP A | 213 | −12.790 | 46.331 | 51.229 | 1.00 | 0.00 | XXXX | 1547 |
| ATOM | 1548 | OD1 | ASP A | 213 | −13.942 | 46.759 | 51.445 | 1.00 | 0.00 | XXXX | 1548 |
| ATOM | 1549 | OD2 | ASP A | 213 | −11.762 | 46.928 | 51.617 | 1.00 | 0.00 | XXXX | 1549 |
| ATOM | 1550 | N | SER A | 214 | −16.150 | 44.981 | 50.028 | 1.00 | 0.00 | XXXX | 1550 |
| ATOM | 1551 | CA | SER A | 214 | −17.439 | 44.489 | 50.508 | 1.00 | 0.00 | XXXX | 1551 |
| ATOM | 1552 | C | SER A | 214 | −17.623 | 43.043 | 50.059 | 1.00 | 0.00 | XXXX | 1552 |
| ATOM | 1553 | O | SER A | 214 | −18.241 | 42.239 | 50.755 | 1.00 | 0.00 | XXXX | 1553 |
| ATOM | 1554 | CB | SER A | 214 | −18.598 | 45.350 | 49.992 | 1.00 | 0.00 | XXXX | 1554 |
| ATOM | 1555 | OG | SER A | 214 | −18.804 | 46.503 | 50.792 | 1.00 | 0.00 | XXXX | 1555 |
| ATOM | 1556 | N | ASN A | 215 | −17.077 | 42.726 | 48.888 | 1.00 | 0.00 | XXXX | 1556 |
| ATOM | 1557 | CA | ASN A | 215 | −17.169 | 41.384 | 48.320 | 1.00 | 0.00 | XXXX | 1557 |
| ATOM | 1558 | C | ASN A | 215 | −16.487 | 40.325 | 49.178 | 1.00 | 0.00 | XXXX | 1558 |
| ATOM | 1559 | O | ASN A | 215 | −16.920 | 39.174 | 49.218 | 1.00 | 0.00 | XXXX | 1559 |
| ATOM | 1560 | CB | ASN A | 215 | −16.568 | 41.365 | 46.912 | 1.00 | 0.00 | XXXX | 1560 |
| ATOM | 1561 | CG | ASN A | 215 | −17.489 | 41.978 | 45.874 | 1.00 | 0.00 | XXXX | 1561 |
| ATOM | 1562 | OD1 | ASN A | 215 | −18.447 | 41.347 | 45.431 | 1.00 | 0.00 | XXXX | 1562 |
| ATOM | 1563 | ND2 | ASN A | 215 | −17.201 | 43.214 | 45.479 | 1.00 | 0.00 | XXXX | 1563 |
| ATOM | 1564 | N | VAL A | 216 | −15.415 | 40.717 | 49.858 | 1.00 | 0.00 | XXXX | 1564 |
| ATOM | 1565 | CA | VAL A | 216 | −14.700 | 39.800 | 50.735 | 1.00 | 0.00 | XXXX | 1565 |
| ATOM | 1566 | C | VAL A | 216 | −15.616 | 39.350 | 51.866 | 1.00 | 0.00 | XXXX | 1566 |
| ATOM | 1567 | O | VAL A | 216 | −15.701 | 38.162 | 52.180 | 1.00 | 0.00 | XXXX | 1567 |
| ATOM | 1568 | CB | VAL A | 216 | −13.436 | 40.444 | 51.328 | 1.00 | 0.00 | XXXX | 1568 |
| ATOM | 1569 | CG1 | VAL A | 216 | −12.771 | 39.494 | 52.314 | 1.00 | 0.00 | XXXX | 1569 |
| ATOM | 1570 | CG2 | VAL A | 216 | −12.469 | 40.837 | 50.217 | 1.00 | 0.00 | XXXX | 1570 |
| ATOM | 1571 | N | ALA A | 217 | −16.306 | 40.314 | 52.466 | 1.00 | 0.00 | XXXX | 1571 |
| ATOM | 1572 | CA | ALA A | 217 | −17.206 | 40.042 | 53.579 | 1.00 | 0.00 | XXXX | 1572 |
| ATOM | 1573 | C | ALA A | 217 | −18.428 | 39.244 | 53.135 | 1.00 | 0.00 | XXXX | 1573 |
| ATOM | 1574 | O | ALA A | 217 | −18.841 | 38.305 | 53.814 | 1.00 | 0.00 | XXXX | 1574 |
| ATOM | 1575 | CB | ALA A | 217 | −17.638 | 41.346 | 54.240 | 1.00 | 0.00 | XXXX | 1575 |
| ATOM | 1576 | N | PHE A | 218 | −19.006 | 39.617 | 51.997 | 1.00 | 0.00 | XXXX | 1576 |
| ATOM | 1577 | CA | PHE A | 218 | −20.240 | 38.986 | 51.539 | 1.00 | 0.00 | XXXX | 1577 |
| ATOM | 1578 | C | PHE A | 218 | −20.071 | 37.496 | 51.243 | 1.00 | 0.00 | XXXX | 1578 |
| ATOM | 1579 | O | PHE A | 218 | −20.829 | 36.669 | 51.750 | 1.00 | 0.00 | XXXX | 1579 |
| ATOM | 1580 | CB | PHE A | 218 | −20.781 | 39.688 | 50.293 | 1.00 | 0.00 | XXXX | 1580 |
| ATOM | 1581 | CG | PHE A | 218 | −21.935 | 38.969 | 49.655 | 1.00 | 0.00 | XXXX | 1581 |
| ATOM | 1582 | CD1 | PHE A | 218 | −23.155 | 38.880 | 50.303 | 1.00 | 0.00 | XXXX | 1582 |
| ATOM | 1583 | CD2 | PHE A | 218 | −21.798 | 38.372 | 48.412 | 1.00 | 0.00 | XXXX | 1583 |
| ATOM | 1584 | CE1 | PHE A | 218 | −24.219 | 38.214 | 49.725 | 1.00 | 0.00 | XXXX | 1584 |
| ATOM | 1585 | CE2 | PHE A | 218 | −22.857 | 37.704 | 47.828 | 1.00 | 0.00 | XXXX | 1585 |
| ATOM | 1586 | CZ | PHE A | 218 | −24.070 | 37.627 | 48.484 | 1.00 | 0.00 | XXXX | 1586 |
| ATOM | 1587 | N | PHE A | 219 | −19.082 | 37.157 | 50.422 | 1.00 | 0.00 | XXXX | 1587 |
| ATOM | 1588 | CA | PHE A | 219 | −18.921 | 35.779 | 49.970 | 1.00 | 0.00 | XXXX | 1588 |
| ATOM | 1589 | C | PHE A | 219 | −18.449 | 34.843 | 51.078 | 1.00 | 0.00 | XXXX | 1589 |
| ATOM | 1590 | O | PHE A | 219 | −18.822 | 33.670 | 51.103 | 1.00 | 0.00 | XXXX | 1590 |
| ATOM | 1591 | CB | PHE A | 219 | −17.961 | 35.715 | 48.781 | 1.00 | 0.00 | XXXX | 1591 |
| ATOM | 1592 | CG | PHE A | 219 | −18.583 | 36.148 | 47.484 | 1.00 | 0.00 | XXXX | 1592 |
| ATOM | 1593 | CD1 | PHE A | 219 | −19.451 | 35.306 | 46.809 | 1.00 | 0.00 | XXXX | 1593 |
| ATOM | 1594 | CD2 | PHE A | 219 | −18.305 | 37.391 | 46.941 | 1.00 | 0.00 | XXXX | 1594 |
| ATOM | 1595 | CE1 | PHE A | 219 | −20.032 | 35.694 | 45.617 | 1.00 | 0.00 | XXXX | 1595 |
| ATOM | 1596 | CE2 | PHE A | 219 | −18.883 | 37.785 | 45.746 | 1.00 | 0.00 | XXXX | 1596 |
| ATOM | 1597 | CZ | PHE A | 219 | −19.747 | 36.934 | 45.084 | 1.00 | 0.00 | XXXX | 1597 |
| ATOM | 1598 | N | LYS A | 220 | −17.635 | 35.355 | 51.995 | 1.00 | 0.00 | XXXX | 1598 |
| ATOM | 1599 | CA | LYS A | 220 | −17.214 | 34.551 | 53.133 | 1.00 | 0.00 | XXXX | 1599 |
| ATOM | 1600 | C | LYS A | 220 | −18.417 | 34.243 | 54.015 | 1.00 | 0.00 | XXXX | 1600 |
| ATOM | 1601 | O | LYS A | 220 | −18.608 | 33.107 | 54.443 | 1.00 | 0.00 | XXXX | 1601 |
| ATOM | 1602 | CB | LYS A | 220 | −16.119 | 35.258 | 53.936 | 1.00 | 0.00 | XXXX | 1602 |
| ATOM | 1603 | CG | LYS A | 220 | −14.773 | 35.292 | 53.231 | 1.00 | 0.00 | XXXX | 1603 |
| ATOM | 1604 | CD | LYS A | 220 | −13.673 | 35.827 | 54.135 | 1.00 | 0.00 | XXXX | 1604 |
| ATOM | 1605 | CE | LYS A | 220 | −12.350 | 35.922 | 53.389 | 1.00 | 0.00 | XXXX | 1605 |
| ATOM | 1606 | NZ | LYS A | 220 | −11.265 | 36.486 | 54.237 | 1.00 | 0.00 | XXXX | 1606 |
| ATOM | 1607 | N | GLN A | 221 | −19.233 | 35.258 | 54.274 | 1.00 | 0.00 | XXXX | 1607 |
| ATOM | 1608 | CA | GLN A | 221 | −20.415 | 35.084 | 55.111 | 1.00 | 0.00 | XXXX | 1608 |
| ATOM | 1609 | C | GLN A | 221 | −21.485 | 34.259 | 54.397 | 1.00 | 0.00 | XXXX | 1609 |
| ATOM | 1610 | O | GLN A | 221 | −22.267 | 33.554 | 55.037 | 1.00 | 0.00 | XXXX | 1610 |
| ATOM | 1611 | CB | GLN A | 221 | −20.977 | 36.444 | 55.530 | 1.00 | 0.00 | XXXX | 1611 |
| ATOM | 1612 | CG | GLN A | 221 | −20.173 | 37.120 | 56.633 | 1.00 | 0.00 | XXXX | 1612 |
| ATOM | 1613 | CD | GLN A | 221 | −20.535 | 38.582 | 56.811 | 1.00 | 0.00 | XXXX | 1613 |
| ATOM | 1614 | OE1 | GLN A | 221 | −21.712 | 38.942 | 56.848 | 1.00 | 0.00 | XXXX | 1614 |
| ATOM | 1615 | NE2 | GLN A | 221 | −19.521 | 39.434 | 56.929 | 1.00 | 0.00 | XXXX | 1615 |
| ATOM | 1616 | N | LEU A | 222 | −21.519 | 34.355 | 53.071 | 1.00 | 0.00 | XXXX | 1616 |
| ATOM | 1617 | CA | LEU A | 222 | −22.457 | 33.570 | 52.274 | 1.00 | 0.00 | XXXX | 1617 |
| ATOM | 1618 | C | LEU A | 222 | −22.166 | 32.078 | 52.417 | 1.00 | 0.00 | XXXX | 1618 |
| ATOM | 1619 | O | LEU A | 222 | −23.074 | 31.279 | 52.649 | 1.00 | 0.00 | XXXX | 1619 |
| ATOM | 1620 | CB | LEU A | 222 | −22.402 | 33.988 | 50.800 | 1.00 | 0.00 | XXXX | 1620 |
| ATOM | 1621 | CG | LEU A | 222 | −23.426 | 33.332 | 49.871 | 1.00 | 0.00 | XXXX | 1621 |
| ATOM | 1622 | CD1 | LEU A | 222 | −24.844 | 33.725 | 50.262 | 1.00 | 0.00 | XXXX | 1622 |

-continued

| | | | | | | | | | | |
|---|---|---|---|---|---|---|---|---|---|---|
| ATOM | 1623 | CD2 | LEU A | 222 | −23.150 | 33.694 | 48.419 | 1.00 | 0.00 | XXXX | 1623 |
| ATOM | 1624 | N | LYS A | 223 | −20.899 | 31.705 | 52.273 | 1.00 | 0.00 | XXXX | 1624 |
| ATOM | 1625 | CA | LYS A | 223 | −20.494 | 30.311 | 52.425 | 1.00 | 0.00 | XXXX | 1625 |
| ATOM | 1626 | C | LYS A | 223 | −20.689 | 29.817 | 53.854 | 1.00 | 0.00 | XXXX | 1626 |
| ATOM | 1627 | O | LYS A | 223 | −21.160 | 28.702 | 54.079 | 1.00 | 0.00 | XXXX | 1627 |
| ATOM | 1628 | CB | LYS A | 223 | −19.032 | 30.128 | 52.011 | 1.00 | 0.00 | XXXX | 1628 |
| ATOM | 1629 | CG | LYS A | 223 | −18.544 | 28.689 | 52.099 | 1.00 | 0.00 | XXXX | 1629 |
| ATOM | 1630 | CD | LYS A | 223 | −17.094 | 28.561 | 51.657 | 1.00 | 0.00 | XXXX | 1630 |
| ATOM | 1631 | CE | LYS A | 223 | −16.591 | 27.132 | 51.806 | 1.00 | 0.00 | XXXX | 1631 |
| ATOM | 1632 | NZ | LYS A | 223 | −16.509 | 26.712 | 53.235 | 1.00 | 0.00 | XXXX | 1632 |
| ATOM | 1633 | N | ASP A | 224 | −20.325 | 30.654 | 54.819 | 1.00 | 0.00 | XXXX | 1633 |
| ATOM | 1634 | CA | ASP A | 224 | −20.433 | 30.285 | 56.225 | 1.00 | 0.00 | XXXX | 1634 |
| ATOM | 1635 | C | ASP A | 224 | −21.892 | 30.175 | 56.655 | 1.00 | 0.00 | XXXX | 1635 |
| ATOM | 1636 | O | ASP A | 224 | −22.207 | 29.527 | 57.652 | 1.00 | 0.00 | XXXX | 1636 |
| ATOM | 1637 | CB | ASP A | 224 | −19.690 | 31.291 | 57.105 | 1.00 | 0.00 | XXXX | 1637 |
| ATOM | 1638 | CG | ASP A | 224 | −18.184 | 31.211 | 56.932 | 1.00 | 0.00 | XXXX | 1638 |
| ATOM | 1639 | OD1 | ASP A | 224 | −17.704 | 30.240 | 56.308 | 1.00 | 0.00 | XXXX | 1639 |
| ATOM | 1640 | OD2 | ASP A | 224 | −17.479 | 32.114 | 57.426 | 1.00 | 0.00 | XXXX | 1640 |
| ATOM | 1641 | N | ALA A | 225 | −22.778 | 30.813 | 55.897 | 1.00 | 0.00 | XXXX | 1641 |
| ATOM | 1642 | CA | ALA A | 225 | −24.208 | 30.726 | 56.160 | 1.00 | 0.00 | XXXX | 1642 |
| ATOM | 1643 | C | ALA A | 225 | −24.802 | 29.459 | 55.548 | 1.00 | 0.00 | XXXX | 1643 |
| ATOM | 1644 | O | ALA A | 225 | −26.008 | 29.225 | 55.631 | 1.00 | 0.00 | XXXX | 1644 |
| ATOM | 1645 | CB | ALA A | 225 | −24.922 | 31.962 | 55.628 | 1.00 | 0.00 | XXXX | 1645 |
| ATOM | 1646 | N | GLY A | 226 | −23.952 | 28.644 | 54.931 | 1.00 | 0.00 | XXXX | 1646 |
| ATOM | 1647 | CA | GLY A | 226 | −24.376 | 27.353 | 54.419 | 1.00 | 0.00 | XXXX | 1647 |
| ATOM | 1648 | C | GLY A | 226 | −24.905 | 27.370 | 52.996 | 1.00 | 0.00 | XXXX | 1648 |
| ATOM | 1649 | O | GLY A | 226 | −25.503 | 26.395 | 52.542 | 1.00 | 0.00 | XXXX | 1649 |
| ATOM | 1650 | N | ILE A | 227 | −24.676 | 28.469 | 52.286 | 1.00 | 0.00 | XXXX | 1650 |
| ATOM | 1651 | CA | ILE A | 227 | −25.147 | 28.601 | 50.910 | 1.00 | 0.00 | XXXX | 1651 |
| ATOM | 1652 | C | ILE A | 227 | −24.023 | 28.358 | 49.904 | 1.00 | 0.00 | XXXX | 1652 |
| ATOM | 1653 | O | ILE A | 227 | −23.001 | 29.044 | 49.924 | 1.00 | 0.00 | XXXX | 1653 |
| ATOM | 1654 | CB | ILE A | 227 | −25.766 | 29.989 | 50.663 | 1.00 | 0.00 | XXXX | 1654 |
| ATOM | 1655 | CG1 | ILE A | 227 | −26.994 | 30.182 | 51.556 | 1.00 | 0.00 | XXXX | 1655 |
| ATOM | 1656 | CG2 | ILE A | 227 | −26.136 | 30.153 | 49.195 | 1.00 | 0.00 | XXXX | 1656 |
| ATOM | 1657 | CD1 | ILE A | 227 | −27.503 | 31.608 | 51.605 | 1.00 | 0.00 | XXXX | 1657 |
| ATOM | 1658 | N | ASP A | 228 | −24.222 | 27.381 | 49.022 | 1.00 | 0.00 | XXXX | 1658 |
| ATOM | 1659 | CA | ASP A | 228 | −23.233 | 27.064 | 47.995 | 1.00 | 0.00 | XXXX | 1659 |
| ATOM | 1660 | C | ASP A | 228 | −23.696 | 27.490 | 46.603 | 1.00 | 0.00 | XXXX | 1660 |
| ATOM | 1661 | O | ASP A | 228 | −24.862 | 27.835 | 46.406 | 1.00 | 0.00 | XXXX | 1661 |
| ATOM | 1662 | CB | ASP A | 228 | −22.928 | 25.565 | 48.001 | 1.00 | 0.00 | XXXX | 1662 |
| ATOM | 1663 | CG | ASP A | 228 | −24.138 | 24.724 | 47.639 | 1.00 | 0.00 | XXXX | 1663 |
| ATOM | 1664 | OD1 | ASP A | 228 | −24.321 | 24.431 | 46.439 | 1.00 | 0.00 | XXXX | 1664 |
| ATOM | 1665 | OD2 | ASP A | 228 | −24.908 | 24.358 | 48.553 | 1.00 | 0.00 | XXXX | 1665 |
| ATOM | 1666 | N | ALA A | 229 | −22.774 | 27.461 | 45.643 | 1.00 | 0.00 | XXXX | 1666 |
| ATOM | 1667 | CA | ALA A | 229 | −23.041 | 27.969 | 44.300 | 1.00 | 0.00 | XXXX | 1667 |
| ATOM | 1668 | C | ALA A | 229 | −24.084 | 27.157 | 43.528 | 1.00 | 0.00 | XXXX | 1668 |
| ATOM | 1669 | O | ALA A | 229 | −24.774 | 27.696 | 42.663 | 1.00 | 0.00 | XXXX | 1669 |
| ATOM | 1670 | CB | ALA A | 229 | −21.739 | 28.033 | 43.507 | 1.00 | 0.00 | XXXX | 1670 |
| ATOM | 1671 | N | ASN A | 230 | −24.204 | 25.871 | 43.841 | 1.00 | 0.00 | XXXX | 1671 |
| ATOM | 1672 | CA | ASN A | 230 | −25.213 | 25.025 | 43.204 | 1.00 | 0.00 | XXXX | 1672 |
| ATOM | 1673 | C | ASN A | 230 | −26.613 | 25.354 | 43.700 | 1.00 | 0.00 | XXXX | 1673 |
| ATOM | 1674 | O | ASN A | 230 | −27.565 | 25.398 | 42.921 | 1.00 | 0.00 | XXXX | 1674 |
| ATOM | 1675 | CB | ASN A | 230 | −24.908 | 23.543 | 43.425 | 1.00 | 0.00 | XXXX | 1675 |
| ATOM | 1676 | CG | ASN A | 230 | −23.755 | 23.058 | 42.570 | 1.00 | 0.00 | XXXX | 1676 |
| ATOM | 1677 | OD1 | ASN A | 230 | −23.588 | 23.500 | 41.433 | 1.00 | 0.00 | XXXX | 1677 |
| ATOM | 1678 | ND2 | ASN A | 230 | −22.964 | 22.135 | 43.104 | 1.00 | 0.00 | XXXX | 1678 |
| ATOM | 1679 | N | THR A | 231 | −26.730 | 25.596 | 45.000 | 1.00 | 0.00 | XXXX | 1679 |
| ATOM | 1680 | CA | THR A | 231 | −28.015 | 25.927 | 45.596 | 1.00 | 0.00 | XXXX | 1680 |
| ATOM | 1681 | C | THR A | 231 | −28.431 | 27.335 | 45.188 | 1.00 | 0.00 | XXXX | 1681 |
| ATOM | 1682 | O | THR A | 231 | −29.597 | 27.582 | 44.883 | 1.00 | 0.00 | XXXX | 1682 |
| ATOM | 1683 | CB | THR A | 231 | −27.969 | 25.825 | 47.132 | 1.00 | 0.00 | XXXX | 1683 |
| ATOM | 1684 | OG1 | THR A | 231 | −27.499 | 24.526 | 47.515 | 1.00 | 0.00 | XXXX | 1684 |
| ATOM | 1685 | CG2 | THR A | 231 | −29.352 | 26.054 | 47.725 | 1.00 | 0.00 | XXXX | 1685 |
| ATOM | 1686 | N | LEU A | 232 | −27.476 | 28.258 | 45.187 | 1.00 | 0.00 | XXXX | 1686 |
| ATOM | 1687 | CA | LEU A | 232 | −27.761 | 29.635 | 44.805 | 1.00 | 0.00 | XXXX | 1687 |
| ATOM | 1688 | C | LEU A | 232 | −26.567 | 30.253 | 44.089 | 1.00 | 0.00 | XXXX | 1688 |
| ATOM | 1689 | O | LEU A | 232 | −25.644 | 30.751 | 44.732 | 1.00 | 0.00 | XXXX | 1689 |
| ATOM | 1690 | CB | LEU A | 232 | −28.130 | 30.468 | 46.034 | 1.00 | 0.00 | XXXX | 1690 |
| ATOM | 1691 | CG | LEU A | 232 | −28.441 | 31.941 | 45.773 | 1.00 | 0.00 | XXXX | 1691 |
| ATOM | 1692 | CD1 | LEU A | 232 | −29.554 | 32.070 | 44.744 | 1.00 | 0.00 | XXXX | 1692 |
| ATOM | 1693 | CD2 | LEU A | 232 | −28.810 | 32.654 | 47.066 | 1.00 | 0.00 | XXXX | 1693 |
| ATOM | 1694 | N | PRO A | 233 | −26.584 | 30.225 | 42.750 | 1.00 | 0.00 | XXXX | 1694 |
| ATOM | 1695 | CA | PRO A | 233 | −25.487 | 30.825 | 41.986 | 1.00 | 0.00 | XXXX | 1695 |
| ATOM | 1696 | C | PRO A | 233 | −25.478 | 32.345 | 42.101 | 1.00 | 0.00 | XXXX | 1696 |
| ATOM | 1697 | O | PRO A | 233 | −26.537 | 32.974 | 42.095 | 1.00 | 0.00 | XXXX | 1697 |
| ATOM | 1698 | CB | PRO A | 233 | −25.770 | 30.383 | 40.546 | 1.00 | 0.00 | XXXX | 1698 |
| ATOM | 1699 | CG | PRO A | 233 | −27.215 | 30.022 | 40.520 | 1.00 | 0.00 | XXXX | 1699 |
| ATOM | 1700 | CD | PRO A | 233 | −27.562 | 29.537 | 41.891 | 1.00 | 0.00 | XXXX | 1700 |
| ATOM | 1701 | N | VAL A | 234 | −24.286 | 32.920 | 42.210 | 1.00 | 0.00 | XXXX | 1701 |

-continued

| | | | | | | | | | | |
|---|---|---|---|---|---|---|---|---|---|---|
| ATOM | 1702 | CA | VAL A | 234 | −24.125 | 34.368 | 42.219 | 1.00 | 0.00 XXXX | 1702 |
| ATOM | 1703 | C | VAL A | 234 | −23.410 | 34.833 | 40.956 | 1.00 | 0.00 XXXX | 1703 |
| ATOM | 1704 | O | VAL A | 234 | −22.288 | 34.411 | 40.679 | 1.00 | 0.00 XXXX | 1704 |
| ATOM | 1705 | CB | VAL A | 234 | −23.334 | 34.842 | 43.455 | 1.00 | 0.00 XXXX | 1705 |
| ATOM | 1706 | CG1 | VAL A | 234 | −23.134 | 36.349 | 43.413 | 1.00 | 0.00 XXXX | 1706 |
| ATOM | 1707 | CG2 | VAL A | 234 | −24.044 | 34.422 | 44.734 | 1.00 | 0.00 XXXX | 1707 |
| ATOM | 1708 | N | MET A | 235 | −24.065 | 35.698 | 40.189 | 1.00 | 0.00 XXXX | 1708 |
| ATOM | 1709 | CA | MET A | 235 | −23.438 | 36.302 | 39.021 | 1.00 | 0.00 XXXX | 1709 |
| ATOM | 1710 | C | MET A | 235 | −22.902 | 37.684 | 39.378 | 1.00 | 0.00 XXXX | 1710 |
| ATOM | 1711 | O | MET A | 235 | −23.659 | 38.564 | 39.788 | 1.00 | 0.00 XXXX | 1711 |
| ATOM | 1712 | CB | MET A | 235 | −24.430 | 36.393 | 37.859 | 1.00 | 0.00 XXXX | 1712 |
| ATOM | 1713 | CG | MET A | 235 | −23.920 | 37.176 | 36.657 | 1.00 | 0.00 XXXX | 1713 |
| ATOM | 1714 | SD | MET A | 235 | −22.586 | 36.339 | 35.777 | 1.00 | 0.00 XXXX | 1714 |
| ATOM | 1715 | CE | MET A | 235 | −23.498 | 35.071 | 34.901 | 1.00 | 0.00 XXXX | 1715 |
| ATOM | 1716 | N | SER A | 236 | −21.594 | 37.868 | 39.223 | 1.00 | 0.00 XXXX | 1716 |
| ATOM | 1717 | CA | SER A | 236 | −20.941 | 39.124 | 39.577 | 1.00 | 0.00 XXXX | 1717 |
| ATOM | 1718 | C | SER A | 236 | −20.386 | 39.826 | 38.342 | 1.00 | 0.00 XXXX | 1718 |
| ATOM | 1719 | O | SER A | 236 | −19.966 | 39.174 | 37.385 | 1.00 | 0.00 XXXX | 1719 |
| ATOM | 1720 | CB | SER A | 236 | −19.822 | 38.877 | 40.592 | 1.00 | 0.00 XXXX | 1720 |
| ATOM | 1721 | OG | SER A | 236 | −20.340 | 38.356 | 41.803 | 1.00 | 0.00 XXXX | 1721 |
| ATOM | 1722 | N | VAL A | 237 | −20.388 | 41.155 | 38.365 | 1.00 | 0.00 XXXX | 1722 |
| ATOM | 1723 | CA | VAL A | 237 | −19.887 | 41.931 | 37.236 | 1.00 | 0.00 XXXX | 1723 |
| ATOM | 1724 | C | VAL A | 237 | −18.811 | 42.943 | 37.627 | 1.00 | 0.00 XXXX | 1724 |
| ATOM | 1725 | O | VAL A | 237 | −18.301 | 43.667 | 36.774 | 1.00 | 0.00 XXXX | 1725 |
| ATOM | 1726 | CB | VAL A | 237 | −21.033 | 42.688 | 36.532 | 1.00 | 0.00 XXXX | 1726 |
| ATOM | 1727 | CG1 | VAL A | 237 | −21.972 | 41.707 | 35.840 | 1.00 | 0.00 XXXX | 1727 |
| ATOM | 1728 | CG2 | VAL A | 237 | −21.791 | 43.556 | 37.529 | 1.00 | 0.00 XXXX | 1728 |
| ATOM | 1729 | N | SER A | 238 | −18.454 | 42.988 | 38.907 | 1.00 | 0.00 XXXX | 1729 |
| ATOM | 1730 | CA | SER A | 238 | −17.451 | 43.947 | 39.362 | 1.00 | 0.00 XXXX | 1730 |
| ATOM | 1731 | C | SER A | 238 | −16.319 | 43.283 | 40.139 | 1.00 | 0.00 XXXX | 1731 |
| ATOM | 1732 | O | SER A | 238 | −15.515 | 43.961 | 40.782 | 1.00 | 0.00 XXXX | 1732 |
| ATOM | 1733 | CB | SER A | 238 | −18.104 | 45.037 | 40.213 | 1.00 | 0.00 XXXX | 1733 |
| ATOM | 1734 | OG | SER A | 238 | −19.073 | 45.751 | 39.462 | 1.00 | 0.00 XXXX | 1734 |
| ATOM | 1735 | N | ILE A | 239 | −16.259 | 41.957 | 40.078 | 1.00 | 0.00 XXXX | 1735 |
| ATOM | 1736 | CA | ILE A | 239 | −15.098 | 41.223 | 40.569 | 1.00 | 0.00 XXXX | 1736 |
| ATOM | 1737 | C | ILE A | 239 | −14.612 | 40.239 | 39.512 | 1.00 | 0.00 XXXX | 1737 |
| ATOM | 1738 | O | ILE A | 239 | −15.405 | 39.702 | 38.739 | 1.00 | 0.00 XXXX | 1738 |
| ATOM | 1739 | CB | ILE A | 239 | −15.399 | 40.459 | 41.873 | 1.00 | 0.00 XXXX | 1739 |
| ATOM | 1740 | CG1 | ILE A | 239 | −16.530 | 39.450 | 41.661 | 1.00 | 0.00 XXXX | 1740 |
| ATOM | 1741 | CG2 | ILE A | 239 | −15.723 | 41.432 | 42.999 | 1.00 | 0.00 XXXX | 1741 |
| ATOM | 1742 | CD1 | ILE A | 239 | −16.622 | 38.404 | 42.752 | 1.00 | 0.00 XXXX | 1742 |
| ATOM | 1743 | N | ALA A | 240 | −13.304 | 40.010 | 39.485 | 1.00 | 0.00 XXXX | 1743 |
| ATOM | 1744 | CA | ALA A | 240 | −12.706 | 39.049 | 38.566 | 1.00 | 0.00 XXXX | 1744 |
| ATOM | 1745 | C | ALA A | 240 | −11.561 | 38.319 | 39.262 | 1.00 | 0.00 XXXX | 1745 |
| ATOM | 1746 | O | ALA A | 240 | −11.529 | 38.246 | 40.491 | 1.00 | 0.00 XXXX | 1746 |
| ATOM | 1747 | CB | ALA A | 240 | −12.219 | 39.744 | 37.303 | 1.00 | 0.00 XXXX | 1747 |
| ATOM | 1748 | N | GLU A | 241 | −10.622 | 37.789 | 38.482 | 1.00 | 0.00 XXXX | 1748 |
| ATOM | 1749 | CA | GLU A | 241 | −9.553 | 36.949 | 39.025 | 1.00 | 0.00 XXXX | 1749 |
| ATOM | 1750 | C | GLU A | 241 | −8.781 | 37.597 | 40.177 | 1.00 | 0.00 XXXX | 1750 |
| ATOM | 1751 | O | GLU A | 241 | −8.388 | 36.915 | 41.125 | 1.00 | 0.00 XXXX | 1751 |
| ATOM | 1752 | CB | GLU A | 241 | −8.569 | 36.552 | 37.920 | 1.00 | 0.00 XXXX | 1752 |
| ATOM | 1753 | CG | GLU A | 241 | −9.081 | 35.474 | 36.974 | 1.00 | 0.00 XXXX | 1753 |
| ATOM | 1754 | CD | GLU A | 241 | −9.751 | 36.035 | 35.734 | 1.00 | 0.00 XXXX | 1754 |
| ATOM | 1755 | OE1 | GLU A | 241 | −10.364 | 37.121 | 35.817 | 1.00 | 0.00 XXXX | 1755 |
| ATOM | 1756 | OE2 | GLU A | 241 | −9.656 | 35.387 | 34.669 | 1.00 | 0.00 XXXX | 1756 |
| ATOM | 1757 | N | GLU A | 242 | −8.563 | 38.905 | 40.096 | 1.00 | 0.00 XXXX | 1757 |
| ATOM | 1758 | CA | GLU A | 242 | −7.810 | 39.608 | 41.131 | 1.00 | 0.00 XXXX | 1758 |
| ATOM | 1759 | C | GLU A | 242 | −8.542 | 39.586 | 42.471 | 1.00 | 0.00 XXXX | 1759 |
| ATOM | 1760 | O | GLU A | 242 | −7.970 | 39.203 | 43.492 | 1.00 | 0.00 XXXX | 1760 |
| ATOM | 1761 | CB | GLU A | 242 | −7.532 | 41.053 | 40.709 | 1.00 | 0.00 XXXX | 1761 |
| ATOM | 1762 | CG | GLU A | 242 | −6.836 | 41.893 | 41.773 | 1.00 | 0.00 XXXX | 1762 |
| ATOM | 1763 | CD | GLU A | 242 | −5.398 | 41.467 | 42.019 | 1.00 | 0.00 XXXX | 1763 |
| ATOM | 1764 | OE1 | GLU A | 242 | −4.891 | 40.600 | 41.276 | 1.00 | 0.00 XXXX | 1764 |
| ATOM | 1765 | OE2 | GLU A | 242 | −4.770 | 42.007 | 42.953 | 1.00 | 0.00 XXXX | 1765 |
| ATOM | 1766 | N | GLU A | 243 | −9.810 | 39.990 | 42.463 | 1.00 | 0.00 XXXX | 1766 |
| ATOM | 1767 | CA | GLU A | 243 | −10.611 | 40.017 | 43.684 | 1.00 | 0.00 XXXX | 1767 |
| ATOM | 1768 | C | GLU A | 243 | −10.901 | 38.610 | 44.192 | 1.00 | 0.00 XXXX | 1768 |
| ATOM | 1769 | O | GLU A | 243 | −10.992 | 38.383 | 45.399 | 1.00 | 0.00 XXXX | 1769 |
| ATOM | 1770 | CB | GLU A | 243 | −11.927 | 40.764 | 43.454 | 1.00 | 0.00 XXXX | 1770 |
| ATOM | 1771 | CG | GLU A | 243 | −11.767 | 42.223 | 43.067 | 1.00 | 0.00 XXXX | 1771 |
| ATOM | 1772 | CD | GLU A | 243 | −11.385 | 42.405 | 41.610 | 1.00 | 0.00 XXXX | 1772 |
| ATOM | 1773 | OE1 | GLU A | 243 | −11.415 | 41.408 | 40.857 | 1.00 | 0.00 XXXX | 1773 |
| ATOM | 1774 | OE2 | GLU A | 243 | −11.059 | 43.547 | 41.220 | 1.00 | 0.00 XXXX | 1774 |
| ATOM | 1775 | N | ILE A | 244 | −11.055 | 37.669 | 43.266 | 1.00 | 0.00 XXXX | 1775 |
| ATOM | 1776 | CA | ILE A | 244 | −11.300 | 36.278 | 43.626 | 1.00 | 0.00 XXXX | 1776 |
| ATOM | 1777 | C | ILE A | 244 | −10.139 | 35.729 | 44.450 | 1.00 | 0.00 XXXX | 1777 |
| ATOM | 1778 | O | ILE A | 244 | −10.345 | 34.992 | 45.413 | 1.00 | 0.00 XXXX | 1778 |
| ATOM | 1779 | CB | ILE A | 244 | −11.517 | 35.400 | 42.382 | 1.00 | 0.00 XXXX | 1779 |
| ATOM | 1780 | CG1 | ILE A | 244 | −12.861 | 35.737 | 41.728 | 1.00 | 0.00 XXXX | 1780 |

-continued

| | | | | | | | | | | |
|---|---|---|---|---|---|---|---|---|---|---|
| ATOM | 1781 | CG2 | ILE A | 244 | −11.474 | 33.929 | 42.759 | 1.00 | 0.00 | XXXX | 1781 |
| ATOM | 1782 | CD1 | ILE A | 244 | −13.055 | 35.109 | 40.363 | 1.00 | 0.00 | XXXX | 1782 |
| ATOM | 1783 | N | LYS A | 245 | −8.920 | 36.091 | 44.065 | 1.00 | 0.00 | XXXX | 1783 |
| ATOM | 1784 | CA | LYS A | 245 | −7.735 | 35.695 | 44.819 | 1.00 | 0.00 | XXXX | 1784 |
| ATOM | 1785 | C | LYS A | 245 | −7.694 | 36.378 | 46.185 | 1.00 | 0.00 | XXXX | 1785 |
| ATOM | 1786 | O | LYS A | 245 | −7.275 | 35.780 | 47.176 | 1.00 | 0.00 | XXXX | 1786 |
| ATOM | 1787 | CB | LYS A | 245 | −6.465 | 36.018 | 44.029 | 1.00 | 0.00 | XXXX | 1787 |
| ATOM | 1788 | CG | LYS A | 245 | −5.854 | 34.822 | 43.323 | 1.00 | 0.00 | XXXX | 1788 |
| ATOM | 1789 | CD | LYS A | 245 | −5.494 | 33.729 | 44.315 | 1.00 | 0.00 | XXXX | 1789 |
| ATOM | 1790 | CE | LYS A | 245 | −4.783 | 32.572 | 43.631 | 1.00 | 0.00 | XXXX | 1790 |
| ATOM | 1791 | NZ | LYS A | 245 | −4.438 | 31.486 | 44.590 | 1.00 | 0.00 | XXXX | 1791 |
| ATOM | 1792 | N | GLY A | 246 | −8.126 | 37.634 | 46.227 | 1.00 | 0.00 | XXXX | 1792 |
| ATOM | 1793 | CA | GLY A | 246 | −8.163 | 38.383 | 47.469 | 1.00 | 0.00 | XXXX | 1793 |
| ATOM | 1794 | C | GLY A | 246 | −9.204 | 37.845 | 48.432 | 1.00 | 0.00 | XXXX | 1794 |
| ATOM | 1795 | O | GLY A | 246 | −8.955 | 37.725 | 49.631 | 1.00 | 0.00 | XXXX | 1795 |
| ATOM | 1796 | N | ILE A | 247 | −10.378 | 37.521 | 47.900 | 1.00 | 0.00 | XXXX | 1796 |
| ATOM | 1797 | CA | ILE A | 247 | −11.468 | 36.985 | 48.707 | 1.00 | 0.00 | XXXX | 1797 |
| ATOM | 1798 | C | ILE A | 247 | −11.163 | 35.563 | 49.157 | 1.00 | 0.00 | XXXX | 1798 |
| ATOM | 1799 | O | ILE A | 247 | −11.462 | 35.176 | 50.287 | 1.00 | 0.00 | XXXX | 1799 |
| ATOM | 1800 | CB | ILE A | 247 | −12.800 | 36.987 | 47.932 | 1.00 | 0.00 | XXXX | 1800 |
| ATOM | 1801 | CG1 | ILE A | 247 | −13.170 | 38.407 | 47.500 | 1.00 | 0.00 | XXXX | 1801 |
| ATOM | 1802 | CG2 | ILE A | 247 | −13.911 | 36.371 | 48.772 | 1.00 | 0.00 | XXXX | 1802 |
| ATOM | 1803 | CD1 | ILE A | 247 | −14.309 | 38.459 | 46.502 | 1.00 | 0.00 | XXXX | 1803 |
| ATOM | 1804 | N | GLY A | 248 | −10.561 | 34.790 | 48.258 | 1.00 | 0.00 | XXXX | 1804 |
| ATOM | 1805 | CA | GLY A | 248 | −10.321 | 33.380 | 48.493 | 1.00 | 0.00 | XXXX | 1805 |
| ATOM | 1806 | C | GLY A | 248 | −11.210 | 32.555 | 47.584 | 1.00 | 0.00 | XXXX | 1806 |
| ATOM | 1807 | O | GLY A | 248 | −12.432 | 32.574 | 47.726 | 1.00 | 0.00 | XXXX | 1807 |
| ATOM | 1808 | N | PRO A | 249 | −10.601 | 31.834 | 46.631 | 1.00 | 0.00 | XXXX | 1808 |
| ATOM | 1809 | CA | PRO A | 249 | −11.335 | 31.017 | 45.657 | 1.00 | 0.00 | XXXX | 1809 |
| ATOM | 1810 | C | PRO A | 249 | −12.268 | 29.997 | 46.306 | 1.00 | 0.00 | XXXX | 1810 |
| ATOM | 1811 | O | PRO A | 249 | −13.252 | 29.592 | 45.688 | 1.00 | 0.00 | XXXX | 1811 |
| ATOM | 1812 | CB | PRO A | 249 | −10.215 | 30.311 | 44.884 | 1.00 | 0.00 | XXXX | 1812 |
| ATOM | 1813 | CG | PRO A | 249 | −9.046 | 31.226 | 45.008 | 1.00 | 0.00 | XXXX | 1813 |
| ATOM | 1814 | CD | PRO A | 249 | −9.148 | 31.801 | 46.392 | 1.00 | 0.00 | XXXX | 1814 |
| ATOM | 1815 | N | GLU A | 250 | −11.968 | 29.597 | 47.538 | 1.00 | 0.00 | XXXX | 1815 |
| ATOM | 1816 | CA | GLU A | 250 | −12.795 | 28.622 | 48.243 | 1.00 | 0.00 | XXXX | 1816 |
| ATOM | 1817 | C | GLU A | 250 | −14.206 | 29.151 | 48.499 | 1.00 | 0.00 | XXXX | 1817 |
| ATOM | 1818 | O | GLU A | 250 | −15.149 | 28.377 | 48.669 | 1.00 | 0.00 | XXXX | 1818 |
| ATOM | 1819 | CB | GLU A | 250 | −12.135 | 28.212 | 49.563 | 1.00 | 0.00 | XXXX | 1819 |
| ATOM | 1820 | CG | GLU A | 250 | −12.074 | 29.308 | 50.612 | 1.00 | 0.00 | XXXX | 1820 |
| ATOM | 1821 | CD | GLU A | 250 | −11.367 | 28.857 | 51.877 | 1.00 | 0.00 | XXXX | 1821 |
| ATOM | 1822 | OE1 | GLU A | 250 | −11.948 | 28.043 | 52.625 | 1.00 | 0.00 | XXXX | 1822 |
| ATOM | 1823 | OE2 | GLU A | 250 | −10.232 | 29.317 | 52.124 | 1.00 | 0.00 | XXXX | 1823 |
| ATOM | 1824 | N | TYR A | 251 | −14.347 | 30.472 | 48.530 | 1.00 | 0.00 | XXXX | 1824 |
| ATOM | 1825 | CA | TYR A | 251 | −15.650 | 31.094 | 48.740 | 1.00 | 0.00 | XXXX | 1825 |
| ATOM | 1826 | C | TYR A | 251 | −16.353 | 31.423 | 47.424 | 1.00 | 0.00 | XXXX | 1826 |
| ATOM | 1827 | O | TYR A | 251 | −17.524 | 31.805 | 47.417 | 1.00 | 0.00 | XXXX | 1827 |
| ATOM | 1828 | CB | TYR A | 251 | −15.505 | 32.363 | 49.582 | 1.00 | 0.00 | XXXX | 1828 |
| ATOM | 1829 | CG | TYR A | 251 | −14.883 | 32.131 | 50.941 | 1.00 | 0.00 | XXXX | 1829 |
| ATOM | 1830 | CD1 | TYR A | 251 | −15.606 | 31.529 | 51.963 | 1.00 | 0.00 | XXXX | 1830 |
| ATOM | 1831 | CD2 | TYR A | 251 | −13.576 | 32.517 | 51.204 | 1.00 | 0.00 | XXXX | 1831 |
| ATOM | 1832 | CE1 | TYR A | 251 | −15.044 | 31.315 | 53.208 | 1.00 | 0.00 | XXXX | 1832 |
| ATOM | 1833 | CE2 | TYR A | 251 | −13.004 | 32.307 | 52.447 | 1.00 | 0.00 | XXXX | 1833 |
| ATOM | 1834 | CZ | TYR A | 251 | −13.743 | 31.706 | 53.445 | 1.00 | 0.00 | XXXX | 1834 |
| ATOM | 1835 | OH | TYR A | 251 | −13.178 | 31.496 | 54.682 | 1.00 | 0.00 | XXXX | 1835 |
| ATOM | 1836 | N | LEU A | 252 | −15.637 | 31.269 | 46.314 | 1.00 | 0.00 | XXXX | 1836 |
| ATOM | 1837 | CA | LEU A | 252 | −16.146 | 31.686 | 45.009 | 1.00 | 0.00 | XXXX | 1837 |
| ATOM | 1838 | C | LEU A | 252 | −16.337 | 30.527 | 44.037 | 1.00 | 0.00 | XXXX | 1838 |
| ATOM | 1839 | O | LEU A | 252 | −16.962 | 30.692 | 42.989 | 1.00 | 0.00 | XXXX | 1839 |
| ATOM | 1840 | CB | LEU A | 252 | −15.214 | 32.724 | 44.379 | 1.00 | 0.00 | XXXX | 1840 |
| ATOM | 1841 | CG | LEU A | 252 | −15.480 | 34.187 | 44.736 | 1.00 | 0.00 | XXXX | 1841 |
| ATOM | 1842 | CD1 | LEU A | 252 | −16.866 | 34.598 | 44.261 | 1.00 | 0.00 | XXXX | 1842 |
| ATOM | 1843 | CD2 | LEU A | 252 | −15.334 | 34.417 | 46.229 | 1.00 | 0.00 | XXXX | 1843 |
| ATOM | 1844 | N | LYS A | 253 | −15.784 | 29.365 | 44.377 | 1.00 | 0.00 | XXXX | 1844 |
| ATOM | 1845 | CA | LYS A | 253 | −15.824 | 28.206 | 43.489 | 1.00 | 0.00 | XXXX | 1845 |
| ATOM | 1846 | C | LYS A | 253 | −17.249 | 27.889 | 43.038 | 1.00 | 0.00 | XXXX | 1846 |
| ATOM | 1847 | O | LYS A | 253 | −18.145 | 27.701 | 43.861 | 1.00 | 0.00 | XXXX | 1847 |
| ATOM | 1848 | CB | LYS A | 253 | −15.209 | 26.988 | 44.184 | 1.00 | 0.00 | XXXX | 1848 |
| ATOM | 1849 | CG | LYS A | 253 | −15.139 | 25.734 | 43.323 | 1.00 | 0.00 | XXXX | 1849 |
| ATOM | 1850 | CD | LYS A | 253 | −14.615 | 24.549 | 44.126 | 1.00 | 0.00 | XXXX | 1850 |
| ATOM | 1851 | CE | LYS A | 253 | −14.589 | 23.273 | 43.299 | 1.00 | 0.00 | XXXX | 1851 |
| ATOM | 1852 | NZ | LYS A | 253 | −15.961 | 22.811 | 42.952 | 1.00 | 0.00 | XXXX | 1852 |
| ATOM | 1853 | N | GLY A | 254 | −17.447 | 27.834 | 41.725 | 1.00 | 0.00 | XXXX | 1853 |
| ATOM | 1854 | CA | GLY A | 254 | −18.740 | 27.495 | 41.158 | 1.00 | 0.00 | XXXX | 1854 |
| ATOM | 1855 | C | GLY A | 254 | −19.612 | 28.689 | 40.815 | 1.00 | 0.00 | XXXX | 1855 |
| ATOM | 1856 | O | GLY A | 254 | −20.572 | 28.560 | 40.054 | 1.00 | 0.00 | XXXX | 1856 |
| ATOM | 1857 | N | HIS A | 255 | −19.284 | 29.855 | 41.365 | 1.00 | 0.00 | XXXX | 1857 |
| ATOM | 1858 | CA | HIS A | 255 | −20.053 | 31.063 | 41.075 | 1.00 | 0.00 | XXXX | 1858 |
| ATOM | 1859 | C | HIS A | 255 | −19.683 | 31.633 | 39.708 | 1.00 | 0.00 | XXXX | 1859 |

-continued

| | | | | | | | | | | |
|---|---|---|---|---|---|---|---|---|---|---|
| ATOM | 1860 | O | HIS A | 255 | −18.738 | 31.170 | 39.069 | 1.00 | 0.00 | XXXX | 1860 |
| ATOM | 1861 | CB | HIS A | 255 | −19.850 | 32.106 | 42.177 | 1.00 | 0.00 | XXXX | 1861 |
| ATOM | 1862 | CG | HIS A | 255 | −20.567 | 31.777 | 43.451 | 1.00 | 0.00 | XXXX | 1862 |
| ATOM | 1863 | ND1 | HIS A | 255 | −21.939 | 31.670 | 43.524 | 1.00 | 0.00 | XXXX | 1863 |
| ATOM | 1864 | CD2 | HIS A | 255 | −20.102 | 31.522 | 44.696 | 1.00 | 0.00 | XXXX | 1864 |
| ATOM | 1865 | CE1 | HIS A | 255 | −22.290 | 31.366 | 44.761 | 1.00 | 0.00 | XXXX | 1865 |
| ATOM | 1866 | NE2 | HIS A | 255 | −21.194 | 31.273 | 45.493 | 1.00 | 0.00 | XXXX | 1866 |
| ATOM | 1867 | N | LEU A | 256 | −20.426 | 32.645 | 39.268 | 1.00 | 0.00 | XXXX | 1867 |
| ATOM | 1868 | CA | LEU A | 256 | −20.380 | 33.071 | 37.872 | 1.00 | 0.00 | XXXX | 1868 |
| ATOM | 1869 | C | LEU A | 256 | −19.924 | 34.515 | 37.682 | 1.00 | 0.00 | XXXX | 1869 |
| ATOM | 1870 | O | LEU A | 256 | −20.129 | 35.368 | 38.546 | 1.00 | 0.00 | XXXX | 1870 |
| ATOM | 1871 | CB | LEU A | 256 | −21.758 | 32.887 | 37.232 | 1.00 | 0.00 | XXXX | 1871 |
| ATOM | 1872 | CG | LEU A | 256 | −22.368 | 31.489 | 37.346 | 1.00 | 0.00 | XXXX | 1872 |
| ATOM | 1873 | CD1 | LEU A | 256 | −23.807 | 31.487 | 36.853 | 1.00 | 0.00 | XXXX | 1873 |
| ATOM | 1874 | CD2 | LEU A | 256 | −21.533 | 30.469 | 36.582 | 1.00 | 0.00 | XXXX | 1874 |
| ATOM | 1875 | N | VAL A | 257 | −19.304 | 34.778 | 36.535 | 1.00 | 0.00 | XXXX | 1875 |
| ATOM | 1876 | CA | VAL A | 257 | −18.925 | 36.133 | 36.155 | 1.00 | 0.00 | XXXX | 1876 |
| ATOM | 1877 | C | VAL A | 257 | −19.212 | 36.389 | 34.680 | 1.00 | 0.00 | XXXX | 1877 |
| ATOM | 1878 | O | VAL A | 257 | −19.292 | 35.456 | 33.882 | 1.00 | 0.00 | XXXX | 1878 |
| ATOM | 1879 | CB | VAL A | 257 | −17.432 | 36.404 | 36.419 | 1.00 | 0.00 | XXXX | 1879 |
| ATOM | 1880 | CG1 | VAL A | 257 | −17.120 | 36.276 | 37.901 | 1.00 | 0.00 | XXXX | 1880 |
| ATOM | 1881 | CG2 | VAL A | 257 | −16.568 | 35.456 | 35.601 | 1.00 | 0.00 | XXXX | 1881 |
| ATOM | 1882 | N | THR A | 258 | −19.369 | 37.660 | 34.328 | 1.00 | 0.00 | XXXX | 1882 |
| ATOM | 1883 | CA | THR A | 258 | −19.444 | 38.064 | 32.931 | 1.00 | 0.00 | XXXX | 1883 |
| ATOM | 1884 | C | THR A | 258 | −18.443 | 39.179 | 32.670 | 1.00 | 0.00 | XXXX | 1884 |
| ATOM | 1885 | O | THR A | 258 | −18.433 | 40.191 | 33.369 | 1.00 | 0.00 | XXXX | 1885 |
| ATOM | 1886 | CB | THR A | 258 | −20.856 | 38.539 | 32.538 | 1.00 | 0.00 | XXXX | 1886 |
| ATOM | 1887 | OG1 | THR A | 258 | −21.800 | 37.487 | 32.775 | 1.00 | 0.00 | XXXX | 1887 |
| ATOM | 1888 | CG2 | THR A | 258 | −20.896 | 38.926 | 31.065 | 1.00 | 0.00 | XXXX | 1888 |
| ATOM | 1889 | N | TRP A | 259 | −17.604 | 38.986 | 31.659 | 1.00 | 0.00 | XXXX | 1889 |
| ATOM | 1890 | CA | TRP A | 259 | −16.571 | 39.955 | 31.320 | 1.00 | 0.00 | XXXX | 1890 |
| ATOM | 1891 | C | TRP A | 259 | −16.281 | 39.912 | 29.826 | 1.00 | 0.00 | XXXX | 1891 |
| ATOM | 1892 | O | TRP A | 259 | −17.011 | 39.283 | 29.060 | 1.00 | 0.00 | XXXX | 1892 |
| ATOM | 1893 | CB | TRP A | 259 | −15.286 | 39.681 | 32.106 | 1.00 | 0.00 | XXXX | 1893 |
| ATOM | 1894 | CG | TRP A | 259 | −15.380 | 39.970 | 33.576 | 1.00 | 0.00 | XXXX | 1894 |
| ATOM | 1895 | CD1 | TRP A | 259 | −15.583 | 39.064 | 34.578 | 1.00 | 0.00 | XXXX | 1895 |
| ATOM | 1896 | CD2 | TRP A | 259 | −15.264 | 41.250 | 34.212 | 1.00 | 0.00 | XXXX | 1896 |
| ATOM | 1897 | NE1 | TRP A | 259 | −15.604 | 39.701 | 35.795 | 1.00 | 0.00 | XXXX | 1897 |
| ATOM | 1898 | CE2 | TRP A | 259 | −15.410 | 41.043 | 35.598 | 1.00 | 0.00 | XXXX | 1898 |
| ATOM | 1899 | CE3 | TRP A | 259 | −15.053 | 42.550 | 33.744 | 1.00 | 0.00 | XXXX | 1899 |
| ATOM | 1900 | CZ2 | TRP A | 259 | −15.351 | 42.087 | 36.520 | 1.00 | 0.00 | XXXX | 1900 |
| ATOM | 1901 | CZ3 | TRP A | 259 | −14.993 | 43.585 | 34.660 | 1.00 | 0.00 | XXXX | 1901 |
| ATOM | 1902 | CH2 | TRP A | 259 | −15.142 | 43.347 | 36.032 | 1.00 | 0.00 | XXXX | 1902 |
| ATOM | 1903 | N | ASN A | 260 | −15.210 | 40.582 | 29.417 | 1.00 | 0.00 | XXXX | 1903 |
| ATOM | 1904 | CA | ASN A | 260 | −14.775 | 40.545 | 28.029 | 1.00 | 0.00 | XXXX | 1904 |
| ATOM | 1905 | C | ASN A | 260 | −13.469 | 39.777 | 27.918 | 1.00 | 0.00 | XXXX | 1905 |
| ATOM | 1906 | O | ASN A | 260 | −12.983 | 39.499 | 26.821 | 1.00 | 0.00 | XXXX | 1906 |
| ATOM | 1907 | CB | ASN A | 260 | −14.605 | 41.959 | 27.479 | 1.00 | 0.00 | XXXX | 1907 |
| ATOM | 1908 | CG | ASN A | 260 | −15.828 | 42.822 | 27.706 | 1.00 | 0.00 | XXXX | 1908 |
| ATOM | 1909 | OD1 | ASN A | 260 | −15.755 | 43.857 | 28.366 | 1.00 | 0.00 | XXXX | 1909 |
| ATOM | 1910 | ND2 | ASN A | 260 | −16.964 | 42.398 | 27.162 | 1.00 | 0.00 | XXXX | 1910 |
| ATOM | 1911 | N | TYR A | 261 | −12.913 | 39.436 | 29.075 | 1.00 | 0.00 | XXXX | 1911 |
| ATOM | 1912 | CA | TYR A | 261 | −11.596 | 38.822 | 29.162 | 1.00 | 0.00 | XXXX | 1912 |
| ATOM | 1913 | C | TYR A | 261 | −11.459 | 37.968 | 30.416 | 1.00 | 0.00 | XXXX | 1913 |
| ATOM | 1914 | O | TYR A | 261 | −11.938 | 38.341 | 31.488 | 1.00 | 0.00 | XXXX | 1914 |
| ATOM | 1915 | CB | TYR A | 261 | −10.505 | 39.900 | 29.143 | 1.00 | 0.00 | XXXX | 1915 |
| ATOM | 1916 | CG | TYR A | 261 | −9.117 | 39.394 | 29.488 | 1.00 | 0.00 | XXXX | 1916 |
| ATOM | 1917 | CD1 | TYR A | 261 | −8.680 | 39.347 | 30.808 | 1.00 | 0.00 | XXXX | 1917 |
| ATOM | 1918 | CD2 | TYR A | 261 | −8.241 | 38.973 | 28.495 | 1.00 | 0.00 | XXXX | 1918 |
| ATOM | 1919 | CE1 | TYR A | 261 | −7.416 | 38.888 | 31.129 | 1.00 | 0.00 | XXXX | 1919 |
| ATOM | 1920 | CE2 | TYR A | 261 | −6.972 | 38.513 | 28.809 | 1.00 | 0.00 | XXXX | 1920 |
| ATOM | 1921 | CZ | TYR A | 261 | −6.566 | 38.474 | 30.126 | 1.00 | 0.00 | XXXX | 1921 |
| ATOM | 1922 | OH | TYR A | 261 | −5.307 | 38.019 | 30.448 | 1.00 | 0.00 | XXXX | 1922 |
| ATOM | 1923 | N | PHE A | 262 | −10.795 | 36.827 | 30.266 | 1.00 | 0.00 | XXXX | 1923 |
| ATOM | 1924 | CA | PHE A | 262 | −10.361 | 36.009 | 31.393 | 1.00 | 0.00 | XXXX | 1924 |
| ATOM | 1925 | C | PHE A | 262 | −8.869 | 35.755 | 31.224 | 1.00 | 0.00 | XXXX | 1925 |
| ATOM | 1926 | O | PHE A | 262 | −8.363 | 35.755 | 30.101 | 1.00 | 0.00 | XXXX | 1926 |
| ATOM | 1927 | CB | PHE A | 262 | −11.113 | 34.673 | 31.459 | 1.00 | 0.00 | XXXX | 1927 |
| ATOM | 1928 | CG | PHE A | 262 | −12.611 | 34.805 | 31.456 | 1.00 | 0.00 | XXXX | 1928 |
| ATOM | 1929 | CD1 | PHE A | 262 | −13.245 | 35.756 | 32.237 | 1.00 | 0.00 | XXXX | 1929 |
| ATOM | 1930 | CD2 | PHE A | 262 | −13.387 | 33.961 | 30.677 | 1.00 | 0.00 | XXXX | 1930 |
| ATOM | 1931 | CE1 | PHE A | 262 | −14.624 | 35.871 | 32.231 | 1.00 | 0.00 | XXXX | 1931 |
| ATOM | 1932 | CE2 | PHE A | 262 | −14.766 | 34.069 | 30.670 | 1.00 | 0.00 | XXXX | 1932 |
| ATOM | 1933 | CZ | PHE A | 262 | −15.385 | 35.025 | 31.447 | 1.00 | 0.00 | XXXX | 1933 |
| ATOM | 1934 | N | GLN A | 263 | −8.162 | 35.551 | 32.330 | 1.00 | 0.00 | XXXX | 1934 |
| ATOM | 1935 | CA | GLN A | 263 | −6.753 | 35.187 | 32.251 | 1.00 | 0.00 | XXXX | 1935 |
| ATOM | 1936 | C | GLN A | 263 | −6.594 | 33.912 | 31.428 | 1.00 | 0.00 | XXXX | 1936 |
| ATOM | 1937 | O | GLN A | 263 | −5.565 | 33.694 | 30.790 | 1.00 | 0.00 | XXXX | 1937 |
| ATOM | 1938 | CB | GLN A | 263 | −6.152 | 34.992 | 33.645 | 1.00 | 0.00 | XXXX | 1938 |

-continued

| | | | | | | | | | | |
|---|---|---|---|---|---|---|---|---|---|---|
| ATOM | 1939 | CG | GLN A | 263 | −4.707 | 34.511 | 33.622 | 1.00 | 0.00 | XXXX | 1939 |
| ATOM | 1940 | CD | GLN A | 263 | −4.144 | 34.256 | 35.008 | 1.00 | 0.00 | XXXX | 1940 |
| ATOM | 1941 | OE1 | GLN A | 263 | −4.574 | 34.864 | 35.988 | 1.00 | 0.00 | XXXX | 1941 |
| ATOM | 1942 | NE2 | GLN A | 263 | −3.173 | 33.354 | 35.094 | 1.00 | 0.00 | XXXX | 1942 |
| ATOM | 1943 | N | SER A | 264 | −7.630 | 33.080 | 31.449 | 1.00 | 0.00 | XXXX | 1943 |
| ATOM | 1944 | CA | SER A | 264 | −7.604 | 31.772 | 30.801 | 1.00 | 0.00 | XXXX | 1944 |
| ATOM | 1945 | C | SER A | 264 | −7.875 | 31.813 | 29.295 | 1.00 | 0.00 | XXXX | 1945 |
| ATOM | 1946 | O | SER A | 264 | −7.899 | 30.768 | 28.643 | 1.00 | 0.00 | XXXX | 1946 |
| ATOM | 1947 | CB | SER A | 264 | −8.619 | 30.844 | 31.469 | 1.00 | 0.00 | XXXX | 1947 |
| ATOM | 1948 | OG | SER A | 264 | −9.926 | 31.392 | 31.399 | 1.00 | 0.00 | XXXX | 1948 |
| ATOM | 1949 | N | VAL A | 265 | −8.084 | 33.005 | 28.745 | 1.00 | 0.00 | XXXX | 1949 |
| ATOM | 1950 | CA | VAL A | 265 | −8.370 | 33.136 | 27.317 | 1.00 | 0.00 | XXXX | 1950 |
| ATOM | 1951 | C | VAL A | 265 | −7.201 | 32.625 | 26.480 | 1.00 | 0.00 | XXXX | 1951 |
| ATOM | 1952 | O | VAL A | 265 | −6.054 | 33.014 | 26.697 | 1.00 | 0.00 | XXXX | 1952 |
| ATOM | 1953 | CB | VAL A | 265 | −8.679 | 34.593 | 26.927 | 1.00 | 0.00 | XXXX | 1953 |
| ATOM | 1954 | CG1 | VAL A | 265 | −8.560 | 34.772 | 25.418 | 1.00 | 0.00 | XXXX | 1954 |
| ATOM | 1955 | CG2 | VAL A | 265 | −10.069 | 34.987 | 27.411 | 1.00 | 0.00 | XXXX | 1955 |
| ATOM | 1956 | N | ASP A | 266 | −7.501 | 31.755 | 25.521 | 1.00 | 0.00 | XXXX | 1956 |
| ATOM | 1957 | CA | ASP A | 266 | −6.461 | 31.108 | 24.728 | 1.00 | 0.00 | XXXX | 1957 |
| ATOM | 1958 | C | ASP A | 266 | −6.190 | 31.840 | 23.420 | 1.00 | 0.00 | XXXX | 1958 |
| ATOM | 1959 | O | ASP A | 266 | −6.745 | 31.499 | 22.375 | 1.00 | 0.00 | XXXX | 1959 |
| ATOM | 1960 | CB | ASP A | 266 | −6.841 | 29.653 | 24.441 | 1.00 | 0.00 | XXXX | 1960 |
| ATOM | 1961 | CG | ASP A | 266 | −5.750 | 28.901 | 23.699 | 1.00 | 0.00 | XXXX | 1961 |
| ATOM | 1962 | OD1 | ASP A | 266 | −4.566 | 29.272 | 23.839 | 1.00 | 0.00 | XXXX | 1962 |
| ATOM | 1963 | OD2 | ASP A | 266 | −6.078 | 27.933 | 22.980 | 1.00 | 0.00 | XXXX | 1963 |
| ATOM | 1964 | N | THR A | 267 | −5.332 | 32.851 | 23.490 | 1.00 | 0.00 | XXXX | 1964 |
| ATOM | 1965 | CA | THR A | 267 | −4.823 | 33.523 | 22.302 | 1.00 | 0.00 | XXXX | 1965 |
| ATOM | 1966 | C | THR A | 267 | −3.313 | 33.674 | 22.426 | 1.00 | 0.00 | XXXX | 1966 |
| ATOM | 1967 | O | THR A | 267 | −2.782 | 33.667 | 23.537 | 1.00 | 0.00 | XXXX | 1967 |
| ATOM | 1968 | CB | THR A | 267 | −5.463 | 34.911 | 22.104 | 1.00 | 0.00 | XXXX | 1968 |
| ATOM | 1969 | OG1 | THR A | 267 | −5.152 | 35.748 | 23.225 | 1.00 | 0.00 | XXXX | 1969 |
| ATOM | 1970 | CG2 | THR A | 267 | −6.975 | 34.795 | 21.970 | 1.00 | 0.00 | XXXX | 1970 |
| ATOM | 1971 | N | PRO A | 268 | −2.614 | 33.805 | 21.288 | 1.00 | 0.00 | XXXX | 1971 |
| ATOM | 1972 | CA | PRO A | 268 | −1.172 | 34.070 | 21.324 | 1.00 | 0.00 | XXXX | 1972 |
| ATOM | 1973 | C | PRO A | 268 | −0.868 | 35.364 | 22.075 | 1.00 | 0.00 | XXXX | 1973 |
| ATOM | 1974 | O | PRO A | 268 | 0.076 | 35.414 | 22.863 | 1.00 | 0.00 | XXXX | 1974 |
| ATOM | 1975 | CB | PRO A | 268 | −0.796 | 34.190 | 19.843 | 1.00 | 0.00 | XXXX | 1975 |
| ATOM | 1976 | CG | PRO A | 268 | −1.875 | 33.459 | 19.111 | 1.00 | 0.00 | XXXX | 1976 |
| ATOM | 1977 | CD | PRO A | 268 | −3.123 | 33.684 | 19.912 | 1.00 | 0.00 | XXXX | 1977 |
| ATOM | 1978 | N | GLU A | 269 | −1.673 | 36.395 | 21.831 | 1.00 | 0.00 | XXXX | 1978 |
| ATOM | 1979 | CA | GLU A | 269 | −1.515 | 37.676 | 22.509 | 1.00 | 0.00 | XXXX | 1979 |
| ATOM | 1980 | C | GLU A | 269 | −1.639 | 37.542 | 24.026 | 1.00 | 0.00 | XXXX | 1980 |
| ATOM | 1981 | O | GLU A | 269 | −0.836 | 38.103 | 24.772 | 1.00 | 0.00 | XXXX | 1981 |
| ATOM | 1982 | CB | GLU A | 269 | −2.540 | 38.692 | 21.994 | 1.00 | 0.00 | XXXX | 1982 |
| ATOM | 1983 | CG | GLU A | 269 | −2.181 | 39.335 | 20.661 | 1.00 | 0.00 | XXXX | 1983 |
| ATOM | 1984 | CD | GLU A | 269 | −2.470 | 38.440 | 19.470 | 1.00 | 0.00 | XXXX | 1984 |
| ATOM | 1985 | OE1 | GLU A | 269 | −3.228 | 37.460 | 19.626 | 1.00 | 0.00 | XXXX | 1985 |
| ATOM | 1986 | OE2 | GLU A | 269 | −1.939 | 38.723 | 18.376 | 1.00 | 0.00 | XXXX | 1986 |
| ATOM | 1987 | N | ASN A | 270 | −2.639 | 36.794 | 24.484 | 1.00 | 0.00 | XXXX | 1987 |
| ATOM | 1988 | CA | ASN A | 270 | −2.866 | 36.652 | 25.918 | 1.00 | 0.00 | XXXX | 1988 |
| ATOM | 1989 | C | ASN A | 270 | −1.784 | 35.830 | 26.606 | 1.00 | 0.00 | XXXX | 1989 |
| ATOM | 1990 | O | ASN A | 270 | −1.416 | 36.110 | 27.748 | 1.00 | 0.00 | XXXX | 1990 |
| ATOM | 1991 | CB | ASN A | 270 | −4.229 | 36.024 | 26.194 | 1.00 | 0.00 | XXXX | 1991 |
| ATOM | 1992 | CG | ASN A | 270 | −4.603 | 36.095 | 27.658 | 1.00 | 0.00 | XXXX | 1992 |
| ATOM | 1993 | OD1 | ASN A | 270 | −4.250 | 37.052 | 28.349 | 1.00 | 0.00 | XXXX | 1993 |
| ATOM | 1994 | ND2 | ASN A | 270 | −5.303 | 35.078 | 28.145 | 1.00 | 0.00 | XXXX | 1994 |
| ATOM | 1995 | N | LYS A | 271 | −1.289 | 34.807 | 25.916 | 1.00 | 0.00 | XXXX | 1995 |
| ATOM | 1996 | CA | LYS A | 271 | −0.185 | 34.008 | 26.432 | 1.00 | 0.00 | XXXX | 1996 |
| ATOM | 1997 | C | LYS A | 271 | 0.997 | 34.919 | 26.751 | 1.00 | 0.00 | XXXX | 1997 |
| ATOM | 1998 | O | LYS A | 271 | 1.606 | 34.814 | 27.816 | 1.00 | 0.00 | XXXX | 1998 |
| ATOM | 1999 | CB | LYS A | 271 | 0.220 | 32.923 | 25.431 | 1.00 | 0.00 | XXXX | 1999 |
| ATOM | 2000 | CG | LYS A | 271 | 1.313 | 31.993 | 25.936 | 1.00 | 0.00 | XXXX | 2000 |
| ATOM | 2001 | CD | LYS A | 271 | 1.626 | 30.897 | 24.928 | 1.00 | 0.00 | XXXX | 2001 |
| ATOM | 2002 | CE | LYS A | 271 | 2.858 | 30.102 | 25.337 | 1.00 | 0.00 | XXXX | 2002 |
| ATOM | 2003 | NZ | LYS A | 271 | 2.655 | 29.391 | 26.631 | 1.00 | 0.00 | XXXX | 2003 |
| ATOM | 2004 | N | GLU A | 272 | 1.309 | 35.812 | 25.816 | 1.00 | 0.00 | XXXX | 2004 |
| ATOM | 2005 | CA | GLU A | 272 | 2.380 | 36.789 | 25.995 | 1.00 | 0.00 | XXXX | 2005 |
| ATOM | 2006 | C | GLU A | 272 | 2.092 | 37.763 | 27.136 | 1.00 | 0.00 | XXXX | 2006 |
| ATOM | 2007 | O | GLU A | 272 | 2.968 | 38.062 | 27.946 | 1.00 | 0.00 | XXXX | 2007 |
| ATOM | 2008 | CB | GLU A | 272 | 2.602 | 37.572 | 24.698 | 1.00 | 0.00 | XXXX | 2008 |
| ATOM | 2009 | CG | GLU A | 272 | 3.214 | 36.759 | 23.574 | 1.00 | 0.00 | XXXX | 2009 |
| ATOM | 2010 | CD | GLU A | 272 | 4.559 | 36.178 | 23.952 | 1.00 | 0.00 | XXXX | 2010 |
| ATOM | 2011 | OE1 | GLU A | 272 | 5.321 | 36.864 | 24.666 | 1.00 | 0.00 | XXXX | 2011 |
| ATOM | 2012 | OE2 | GLU A | 272 | 4.856 | 35.040 | 23.533 | 1.00 | 0.00 | XXXX | 2012 |
| ATOM | 2013 | N | PHE A | 273 | 0.858 | 38.254 | 27.189 | 1.00 | 0.00 | XXXX | 2013 |
| ATOM | 2014 | CA | PHE A | 273 | 0.460 | 39.240 | 28.188 | 1.00 | 0.00 | XXXX | 2014 |
| ATOM | 2015 | C | PHE A | 273 | 0.575 | 38.681 | 29.603 | 1.00 | 0.00 | XXXX | 2015 |
| ATOM | 2016 | O | PHE A | 273 | 1.145 | 39.320 | 30.488 | 1.00 | 0.00 | XXXX | 2016 |
| ATOM | 2017 | CB | PHE A | 273 | −0.969 | 39.722 | 27.917 | 1.00 | 0.00 | XXXX | 2017 |

-continued

| | | | | | | | | | | |
|---|---|---|---|---|---|---|---|---|---|---|
| ATOM | 2018 | CG | PHE A | 273 | −1.494 | 40.690 | 28.942 | 1.00 | 0.00 | XXXX | 2018 |
| ATOM | 2019 | CD1 | PHE A | 273 | −0.838 | 41.885 | 29.190 | 1.00 | 0.00 | XXXX | 2019 |
| ATOM | 2020 | CD2 | PHE A | 273 | −2.660 | 40.416 | 29.638 | 1.00 | 0.00 | XXXX | 2020 |
| ATOM | 2021 | CE1 | PHE A | 273 | −1.323 | 42.779 | 30.127 | 1.00 | 0.00 | XXXX | 2021 |
| ATOM | 2022 | CE2 | PHE A | 273 | −3.152 | 41.308 | 30.575 | 1.00 | 0.00 | XXXX | 2022 |
| ATOM | 2023 | CZ | PHE A | 273 | −2.483 | 42.490 | 30.819 | 1.00 | 0.00 | XXXX | 2023 |
| ATOM | 2024 | N | VAL A | 274 | 0.033 | 37.485 | 29.811 | 1.00 | 0.00 | XXXX | 2024 |
| ATOM | 2025 | CA | VAL A | 274 | 0.074 | 36.845 | 31.120 | 1.00 | 0.00 | XXXX | 2025 |
| ATOM | 2026 | C | VAL A | 274 | 1.504 | 36.505 | 31.538 | 1.00 | 0.00 | XXXX | 2026 |
| ATOM | 2027 | O | VAL A | 274 | 1.879 | 36.692 | 32.697 | 1.00 | 0.00 | XXXX | 2027 |
| ATOM | 2028 | CB | VAL A | 274 | −0.774 | 35.561 | 31.146 | 1.00 | 0.00 | XXXX | 2028 |
| ATOM | 2029 | CG1 | VAL A | 274 | −0.595 | 34.839 | 32.472 | 1.00 | 0.00 | XXXX | 2029 |
| ATOM | 2030 | CG2 | VAL A | 274 | −2.244 | 35.890 | 30.902 | 1.00 | 0.00 | XXXX | 2030 |
| ATOM | 2031 | N | GLU A | 275 | 2.299 | 36.001 | 30.597 | 1.00 | 0.00 | XXXX | 2031 |
| ATOM | 2032 | CA | GLU A | 275 | 3.704 | 35.708 | 30.873 | 1.00 | 0.00 | XXXX | 2032 |
| ATOM | 2033 | C | GLU A | 275 | 4.469 | 36.962 | 31.290 | 1.00 | 0.00 | XXXX | 2033 |
| ATOM | 2034 | O | GLU A | 275 | 5.218 | 36.946 | 32.267 | 1.00 | 0.00 | XXXX | 2034 |
| ATOM | 2035 | CB | GLU A | 275 | 4.376 | 35.066 | 29.656 | 1.00 | 0.00 | XXXX | 2035 |
| ATOM | 2036 | CG | GLU A | 275 | 4.097 | 33.580 | 29.506 | 1.00 | 0.00 | XXXX | 2036 |
| ATOM | 2037 | CD | GLU A | 275 | 4.967 | 32.926 | 28.449 | 1.00 | 0.00 | XXXX | 2037 |
| ATOM | 2038 | OE1 | GLU A | 275 | 6.034 | 33.488 | 28.123 | 1.00 | 0.00 | XXXX | 2038 |
| ATOM | 2039 | OE2 | GLU A | 275 | 4.586 | 31.846 | 27.951 | 1.00 | 0.00 | XXXX | 2039 |
| ATOM | 2040 | N | LYS A | 276 | 4.285 | 38.046 | 30.544 | 1.00 | 0.00 | XXXX | 2040 |
| ATOM | 2041 | CA | LYS A | 276 | 4.964 | 39.301 | 30.852 | 1.00 | 0.00 | XXXX | 2041 |
| ATOM | 2042 | C | LYS A | 276 | 4.487 | 39.898 | 32.177 | 1.00 | 0.00 | XXXX | 2042 |
| ATOM | 2043 | O | LYS A | 276 | 5.288 | 40.420 | 32.953 | 1.00 | 0.00 | XXXX | 2043 |
| ATOM | 2044 | CB | LYS A | 276 | 4.776 | 40.303 | 29.711 | 1.00 | 0.00 | XXXX | 2044 |
| ATOM | 2045 | CG | LYS A | 276 | 5.657 | 40.011 | 28.505 | 1.00 | 0.00 | XXXX | 2045 |
| ATOM | 2046 | CD | LYS A | 276 | 5.599 | 41.121 | 27.468 | 1.00 | 0.00 | XXXX | 2046 |
| ATOM | 2047 | CE | LYS A | 276 | 4.230 | 41.193 | 26.813 | 1.00 | 0.00 | XXXX | 2047 |
| ATOM | 2048 | NZ | LYS A | 276 | 4.197 | 42.191 | 25.708 | 1.00 | 0.00 | XXXX | 2048 |
| ATOM | 2049 | N | TYR A | 277 | 3.183 | 39.837 | 32.429 | 1.00 | 0.00 | XXXX | 2049 |
| ATOM | 2050 | CA | TYR A | 277 | 2.632 | 40.354 | 33.678 | 1.00 | 0.00 | XXXX | 2050 |
| ATOM | 2051 | C | TYR A | 277 | 3.215 | 39.601 | 34.871 | 1.00 | 0.00 | XXXX | 2051 |
| ATOM | 2052 | O | TYR A | 277 | 3.577 | 40.204 | 35.882 | 1.00 | 0.00 | XXXX | 2052 |
| ATOM | 2053 | CB | TYR A | 277 | 1.106 | 40.250 | 33.678 | 1.00 | 0.00 | XXXX | 2053 |
| ATOM | 2054 | CG | TYR A | 277 | 0.426 | 41.081 | 34.745 | 1.00 | 0.00 | XXXX | 2054 |
| ATOM | 2055 | CD1 | TYR A | 277 | 0.172 | 42.432 | 34.544 | 1.00 | 0.00 | XXXX | 2055 |
| ATOM | 2056 | CD2 | TYR A | 277 | 0.030 | 40.512 | 35.949 | 1.00 | 0.00 | XXXX | 2056 |
| ATOM | 2057 | CE1 | TYR A | 277 | −0.454 | 43.194 | 35.513 | 1.00 | 0.00 | XXXX | 2057 |
| ATOM | 2058 | CE2 | TYR A | 277 | −0.597 | 41.266 | 36.924 | 1.00 | 0.00 | XXXX | 2058 |
| ATOM | 2059 | CZ | TYR A | 277 | −0.837 | 42.608 | 36.700 | 1.00 | 0.00 | XXXX | 2059 |
| ATOM | 2060 | OH | TYR A | 277 | −1.461 | 43.366 | 37.666 | 1.00 | 0.00 | XXXX | 2060 |
| ATOM | 2061 | N | LYS A | 278 | 3.308 | 38.281 | 34.743 | 1.00 | 0.00 | XXXX | 2061 |
| ATOM | 2062 | CA | LYS A | 278 | 3.843 | 37.441 | 35.808 | 1.00 | 0.00 | XXXX | 2062 |
| ATOM | 2063 | C | LYS A | 278 | 5.354 | 37.608 | 35.952 | 1.00 | 0.00 | XXXX | 2063 |
| ATOM | 2064 | O | LYS A | 278 | 5.885 | 37.583 | 37.063 | 1.00 | 0.00 | XXXX | 2064 |
| ATOM | 2065 | CB | LYS A | 278 | 3.502 | 35.969 | 35.558 | 1.00 | 0.00 | XXXX | 2065 |
| ATOM | 2066 | CG | LYS A | 278 | 2.040 | 35.613 | 35.807 | 1.00 | 0.00 | XXXX | 2066 |
| ATOM | 2067 | CD | LYS A | 278 | 1.762 | 34.157 | 35.458 | 1.00 | 0.00 | XXXX | 2067 |
| ATOM | 2068 | CE | LYS A | 278 | 0.327 | 33.770 | 35.774 | 1.00 | 0.00 | XXXX | 2068 |
| ATOM | 2069 | NZ | LYS A | 278 | 0.072 | 33.737 | 37.242 | 1.00 | 0.00 | XXXX | 2069 |
| ATOM | 2070 | N | LYS A | 279 | 6.045 | 37.774 | 34.828 | 1.00 | 0.00 | XXXX | 2070 |
| ATOM | 2071 | CA | LYS A | 279 | 7.487 | 37.996 | 34.853 | 1.00 | 0.00 | XXXX | 2071 |
| ATOM | 2072 | C | LYS A | 279 | 7.846 | 39.264 | 35.623 | 1.00 | 0.00 | XXXX | 2072 |
| ATOM | 2073 | O | LYS A | 279 | 8.836 | 39.297 | 36.354 | 1.00 | 0.00 | XXXX | 2073 |
| ATOM | 2074 | CB | LYS A | 279 | 8.048 | 38.077 | 33.432 | 1.00 | 0.00 | XXXX | 2074 |
| ATOM | 2075 | CG | LYS A | 279 | 9.542 | 38.363 | 33.389 | 1.00 | 0.00 | XXXX | 2075 |
| ATOM | 2076 | CD | LYS A | 279 | 10.077 | 38.403 | 31.966 | 1.00 | 0.00 | XXXX | 2076 |
| ATOM | 2077 | CE | LYS A | 279 | 11.551 | 38.787 | 31.947 | 1.00 | 0.00 | XXXX | 2077 |
| ATOM | 2078 | NZ | LYS A | 279 | 12.132 | 38.730 | 30.576 | 1.00 | 0.00 | XXXX | 2078 |
| ATOM | 2079 | N | LYS A | 280 | 7.039 | 40.307 | 35.456 | 1.00 | 0.00 | XXXX | 2079 |
| ATOM | 2080 | CA | LYS A | 280 | 7.305 | 41.581 | 36.114 | 1.00 | 0.00 | XXXX | 2080 |
| ATOM | 2081 | C | LYS A | 280 | 6.900 | 41.585 | 37.585 | 1.00 | 0.00 | XXXX | 2081 |
| ATOM | 2082 | O | LYS A | 280 | 7.633 | 42.097 | 38.430 | 1.00 | 0.00 | XXXX | 2082 |
| ATOM | 2083 | CB | LYS A | 280 | 6.589 | 42.723 | 35.386 | 1.00 | 0.00 | XXXX | 2083 |
| ATOM | 2084 | CG | LYS A | 280 | 6.938 | 44.101 | 35.936 | 1.00 | 0.00 | XXXX | 2084 |
| ATOM | 2085 | CD | LYS A | 280 | 6.360 | 45.215 | 35.082 | 1.00 | 0.00 | XXXX | 2085 |
| ATOM | 2086 | CE | LYS A | 280 | 6.717 | 46.582 | 35.648 | 1.00 | 0.00 | XXXX | 2086 |
| ATOM | 2087 | NZ | LYS A | 280 | 8.186 | 46.743 | 35.838 | 1.00 | 0.00 | XXXX | 2087 |
| ATOM | 2088 | N | TYR A | 281 | 5.736 | 41.020 | 37.891 | 1.00 | 0.00 | XXXX | 2088 |
| ATOM | 2089 | CA | TYR A | 281 | 5.166 | 41.156 | 39.229 | 1.00 | 0.00 | XXXX | 2089 |
| ATOM | 2090 | C | TYR A | 281 | 5.142 | 39.862 | 40.046 | 1.00 | 0.00 | XXXX | 2090 |
| ATOM | 2091 | O | TYR A | 281 | 4.853 | 39.890 | 41.242 | 1.00 | 0.00 | XXXX | 2091 |
| ATOM | 2092 | CB | TYR A | 281 | 3.749 | 41.725 | 39.126 | 1.00 | 0.00 | XXXX | 2092 |
| ATOM | 2093 | CG | TYR A | 281 | 3.717 | 43.116 | 38.538 | 1.00 | 0.00 | XXXX | 2093 |
| ATOM | 2094 | CD1 | TYR A | 281 | 4.353 | 44.172 | 39.176 | 1.00 | 0.00 | XXXX | 2094 |
| ATOM | 2095 | CD2 | TYR A | 281 | 3.057 | 43.373 | 37.343 | 1.00 | 0.00 | XXXX | 2095 |
| ATOM | 2096 | CE1 | TYR A | 281 | 4.334 | 45.444 | 38.644 | 1.00 | 0.00 | XXXX | 2096 |

| | | | | | | | | | | |
|---|---|---|---|---|---|---|---|---|---|---|
| ATOM | 2097 | CE2 | TYR A | 281 | 3.030 | 44.644 | 36.802 | 1.00 | 0.00 | XXXX | 2097 |
| ATOM | 2098 | CZ | TYR A | 281 | 3.671 | 45.676 | 37.457 | 1.00 | 0.00 | XXXX | 2098 |
| ATOM | 2099 | OH | TYR A | 281 | 3.648 | 46.943 | 36.923 | 1.00 | 0.00 | XXXX | 2099 |
| ATOM | 2100 | N | GLY A | 282 | 5.444 | 38.734 | 39.410 | 1.00 | 0.00 | XXXX | 2100 |
| ATOM | 2101 | CA | GLY A | 282 | 5.496 | 37.468 | 40.121 | 1.00 | 0.00 | XXXX | 2101 |
| ATOM | 2102 | C | GLY A | 282 | 4.573 | 36.411 | 39.545 | 1.00 | 0.00 | XXXX | 2102 |
| ATOM | 2103 | O | GLY A | 282 | 3.477 | 36.719 | 39.077 | 1.00 | 0.00 | XXXX | 2103 |
| ATOM | 2104 | N | GLU A | 283 | 5.018 | 35.158 | 39.586 | 1.00 | 0.00 | XXXX | 2104 |
| ATOM | 2105 | CA | GLU A | 283 | 4.272 | 34.051 | 38.993 | 1.00 | 0.00 | XXXX | 2105 |
| ATOM | 2106 | C | GLU A | 283 | 2.931 | 33.791 | 39.675 | 1.00 | 0.00 | XXXX | 2106 |
| ATOM | 2107 | O | GLU A | 283 | 2.069 | 33.112 | 39.119 | 1.00 | 0.00 | XXXX | 2107 |
| ATOM | 2108 | CB | GLU A | 283 | 5.114 | 32.774 | 39.021 | 1.00 | 0.00 | XXXX | 2108 |
| ATOM | 2109 | CG | GLU A | 283 | 6.187 | 32.717 | 37.949 | 1.00 | 0.00 | XXXX | 2109 |
| ATOM | 2110 | CD | GLU A | 283 | 5.615 | 32.829 | 36.549 | 1.00 | 0.00 | XXXX | 2110 |
| ATOM | 2111 | OE1 | GLU A | 283 | 4.609 | 32.146 | 36.261 | 1.00 | 0.00 | XXXX | 2111 |
| ATOM | 2112 | OE2 | GLU A | 283 | 6.172 | 33.598 | 35.736 | 1.00 | 0.00 | XXXX | 2112 |
| ATOM | 2113 | N | ASP A | 284 | 2.754 | 34.331 | 40.876 | 1.00 | 0.00 | XXXX | 2113 |
| ATOM | 2114 | CA | ASP A | 284 | 1.508 | 34.143 | 41.613 | 1.00 | 0.00 | XXXX | 2114 |
| ATOM | 2115 | C | ASP A | 284 | 0.439 | 35.143 | 41.185 | 1.00 | 0.00 | XXXX | 2115 |
| ATOM | 2116 | O | ASP A | 284 | −0.746 | 34.950 | 41.455 | 1.00 | 0.00 | XXXX | 2116 |
| ATOM | 2117 | CB | ASP A | 284 | 1.751 | 34.255 | 43.119 | 1.00 | 0.00 | XXXX | 2117 |
| ATOM | 2118 | CG | ASP A | 284 | 2.195 | 32.943 | 43.737 | 1.00 | 0.00 | XXXX | 2118 |
| ATOM | 2119 | OD1 | ASP A | 284 | 2.534 | 32.010 | 42.978 | 1.00 | 0.00 | XXXX | 2119 |
| ATOM | 2120 | OD2 | ASP A | 284 | 2.197 | 32.843 | 44.982 | 1.00 | 0.00 | XXXX | 2120 |
| ATOM | 2121 | N | ARG A | 285 | 0.862 | 36.209 | 40.515 | 1.00 | 0.00 | XXXX | 2121 |
| ATOM | 2122 | CA | ARG A | 285 | −0.059 | 37.267 | 40.120 | 1.00 | 0.00 | XXXX | 2122 |
| ATOM | 2123 | C | ARG A | 285 | −1.003 | 36.807 | 39.013 | 1.00 | 0.00 | XXXX | 2123 |
| ATOM | 2124 | O | ARG A | 285 | −0.619 | 36.044 | 38.127 | 1.00 | 0.00 | XXXX | 2124 |
| ATOM | 2125 | CB | ARG A | 285 | 0.714 | 38.508 | 39.669 | 1.00 | 0.00 | XXXX | 2125 |
| ATOM | 2126 | CG | ARG A | 285 | 1.504 | 39.178 | 40.782 | 1.00 | 0.00 | XXXX | 2126 |
| ATOM | 2127 | CD | ARG A | 285 | 0.582 | 39.864 | 41.781 | 1.00 | 0.00 | XXXX | 2127 |
| ATOM | 2128 | NE | ARG A | 285 | −0.167 | 40.962 | 41.177 | 1.00 | 0.00 | XXXX | 2128 |
| ATOM | 2129 | CZ | ARG A | 285 | 0.248 | 42.225 | 41.157 | 1.00 | 0.00 | XXXX | 2129 |
| ATOM | 2130 | NH1 | ARG A | 285 | 1.410 | 42.548 | 41.707 | 1.00 | 0.00 | XXXX | 2130 |
| ATOM | 2131 | NH2 | ARG A | 285 | −0.496 | 43.163 | 40.587 | 1.00 | 0.00 | XXXX | 2131 |
| ATOM | 2132 | N | VAL A | 286 | −2.244 | 37.276 | 39.075 | 1.00 | 0.00 | XXXX | 2132 |
| ATOM | 2133 | CA | VAL A | 286 | −3.235 | 36.949 | 38.062 | 1.00 | 0.00 | XXXX | 2133 |
| ATOM | 2134 | C | VAL A | 286 | −3.527 | 38.165 | 37.196 | 1.00 | 0.00 | XXXX | 2134 |
| ATOM | 2135 | O | VAL A | 286 | −3.177 | 39.290 | 37.554 | 1.00 | 0.00 | XXXX | 2135 |
| ATOM | 2136 | CB | VAL A | 286 | −4.549 | 36.458 | 38.688 | 1.00 | 0.00 | XXXX | 2136 |
| ATOM | 2137 | CG1 | VAL A | 286 | −4.311 | 35.197 | 39.502 | 1.00 | 0.00 | XXXX | 2137 |
| ATOM | 2138 | CG2 | VAL A | 286 | −5.156 | 37.549 | 39.556 | 1.00 | 0.00 | XXXX | 2138 |
| ATOM | 2139 | N | THR A | 287 | −4.158 | 37.931 | 36.052 | 1.00 | 0.00 | XXXX | 2139 |
| ATOM | 2140 | CA | THR A | 287 | −4.687 | 39.015 | 35.238 | 1.00 | 0.00 | XXXX | 2140 |
| ATOM | 2141 | C | THR A | 287 | −6.204 | 38.896 | 35.183 | 1.00 | 0.00 | XXXX | 2141 |
| ATOM | 2142 | O | THR A | 287 | −6.759 | 37.839 | 35.481 | 1.00 | 0.00 | XXXX | 2142 |
| ATOM | 2143 | CB | THR A | 287 | −4.112 | 39.005 | 33.809 | 1.00 | 0.00 | XXXX | 2143 |
| ATOM | 2144 | OG1 | THR A | 287 | −4.490 | 37.795 | 33.141 | 1.00 | 0.00 | XXXX | 2144 |
| ATOM | 2145 | CG2 | THR A | 287 | −2.593 | 39.112 | 33.841 | 1.00 | 0.00 | XXXX | 2145 |
| ATOM | 2146 | N | ASP A | 288 | −6.872 | 39.980 | 34.806 | 1.00 | 0.00 | XXXX | 2146 |
| ATOM | 2147 | CA | ASP A | 288 | −8.315 | 39.945 | 34.606 | 1.00 | 0.00 | XXXX | 2147 |
| ATOM | 2148 | C | ASP A | 288 | −8.759 | 41.070 | 33.676 | 1.00 | 0.00 | XXXX | 2148 |
| ATOM | 2149 | O | ASP A | 288 | −7.928 | 41.809 | 33.147 | 1.00 | 0.00 | XXXX | 2149 |
| ATOM | 2150 | CB | ASP A | 288 | −9.061 | 40.004 | 35.951 | 1.00 | 0.00 | XXXX | 2150 |
| ATOM | 2151 | CG | ASP A | 288 | −8.820 | 41.297 | 36.725 | 1.00 | 0.00 | XXXX | 2151 |
| ATOM | 2152 | OD1 | ASP A | 288 | −8.356 | 42.297 | 36.143 | 1.00 | 0.00 | XXXX | 2152 |
| ATOM | 2153 | OD2 | ASP A | 288 | −9.115 | 41.313 | 37.940 | 1.00 | 0.00 | XXXX | 2153 |
| ATOM | 2154 | N | ASP A | 289 | −10.068 | 41.191 | 33.482 | 1.00 | 0.00 | XXXX | 2154 |
| ATOM | 2155 | CA | ASP A | 289 | −10.622 | 42.096 | 32.480 | 1.00 | 0.00 | XXXX | 2155 |
| ATOM | 2156 | C | ASP A | 289 | −10.182 | 43.547 | 32.698 | 1.00 | 0.00 | XXXX | 2156 |
| ATOM | 2157 | O | ASP A | 289 | −9.627 | 44.168 | 31.790 | 1.00 | 0.00 | XXXX | 2157 |
| ATOM | 2158 | CB | ASP A | 289 | −12.151 | 41.995 | 32.475 | 1.00 | 0.00 | XXXX | 2158 |
| ATOM | 2159 | CG | ASP A | 289 | −12.798 | 42.893 | 31.439 | 1.00 | 0.00 | XXXX | 2159 |
| ATOM | 2160 | OD1 | ASP A | 289 | −12.792 | 44.129 | 31.622 | 1.00 | 0.00 | XXXX | 2160 |
| ATOM | 2161 | OD2 | ASP A | 289 | −13.328 | 42.357 | 30.444 | 1.00 | 0.00 | XXXX | 2161 |
| ATOM | 2162 | N | PRO A | 290 | −10.432 | 44.093 | 33.902 | 1.00 | 0.00 | XXXX | 2162 |
| ATOM | 2163 | CA | PRO A | 290 | −10.006 | 45.463 | 34.210 | 1.00 | 0.00 | XXXX | 2163 |
| ATOM | 2164 | C | PRO A | 290 | −8.502 | 45.654 | 34.033 | 1.00 | 0.00 | XXXX | 2164 |
| ATOM | 2165 | O | PRO A | 290 | −8.070 | 46.699 | 33.551 | 1.00 | 0.00 | XXXX | 2165 |
| ATOM | 2166 | CB | PRO A | 290 | −10.410 | 45.634 | 35.676 | 1.00 | 0.00 | XXXX | 2166 |
| ATOM | 2167 | CG | PRO A | 290 | −11.551 | 44.695 | 35.855 | 1.00 | 0.00 | XXXX | 2167 |
| ATOM | 2168 | CD | PRO A | 290 | −11.219 | 43.505 | 35.000 | 1.00 | 0.00 | XXXX | 2168 |
| ATOM | 2169 | N | ILE A | 291 | −7.720 | 44.652 | 34.421 | 1.00 | 0.00 | XXXX | 2169 |
| ATOM | 2170 | CA | ILE A | 291 | −6.272 | 44.705 | 34.245 | 1.00 | 0.00 | XXXX | 2170 |
| ATOM | 2171 | C | ILE A | 291 | −5.891 | 44.784 | 32.766 | 1.00 | 0.00 | XXXX | 2171 |
| ATOM | 2172 | O | ILE A | 291 | −4.987 | 45.533 | 32.390 | 1.00 | 0.00 | XXXX | 2172 |
| ATOM | 2173 | CB | ILE A | 291 | −5.585 | 43.491 | 34.892 | 1.00 | 0.00 | XXXX | 2173 |
| ATOM | 2174 | CG1 | ILE A | 291 | −5.588 | 43.633 | 36.416 | 1.00 | 0.00 | XXXX | 2174 |
| ATOM | 2175 | CG2 | ILE A | 291 | −4.161 | 43.352 | 34.384 | 1.00 | 0.00 | XXXX | 2175 |

-continued

| | | | | | | | | | | |
|---|---|---|---|---|---|---|---|---|---|---|
| ATOM | 2176 | CD1 | ILE A | 291 | −5.166 | 42.375 | 37.147 | 1.00 | 0.00 | XXXX | 2176 |
| ATOM | 2177 | N | GLU A | 292 | −6.578 | 44.013 | 31.927 | 1.00 | 0.00 | XXXX | 2177 |
| ATOM | 2178 | CA | GLU A | 292 | −6.331 | 44.066 | 30.491 | 1.00 | 0.00 | XXXX | 2178 |
| ATOM | 2179 | C | GLU A | 292 | −6.712 | 45.427 | 29.920 | 1.00 | 0.00 | XXXX | 2179 |
| ATOM | 2180 | O | GLU A | 292 | −5.988 | 45.988 | 29.097 | 1.00 | 0.00 | XXXX | 2180 |
| ATOM | 2181 | CB | GLU A | 292 | −7.102 | 42.969 | 29.753 | 1.00 | 0.00 | XXXX | 2181 |
| ATOM | 2182 | CG | GLU A | 292 | −6.723 | 42.871 | 28.279 | 1.00 | 0.00 | XXXX | 2182 |
| ATOM | 2183 | CD | GLU A | 292 | −7.890 | 42.497 | 27.385 | 1.00 | 0.00 | XXXX | 2183 |
| ATOM | 2184 | OE1 | GLU A | 292 | −7.644 | 42.092 | 26.229 | 1.00 | 0.00 | XXXX | 2184 |
| ATOM | 2185 | OE2 | GLU A | 292 | −9.052 | 42.621 | 27.828 | 1.00 | 0.00 | XXXX | 2185 |
| ATOM | 2186 | N | ALA A | 293 | −7.853 | 45.949 | 30.362 | 1.00 | 0.00 | XXXX | 2186 |
| ATOM | 2187 | CA | ALA A | 293 | −8.370 | 47.220 | 29.863 | 1.00 | 0.00 | XXXX | 2187 |
| ATOM | 2188 | C | ALA A | 293 | −7.426 | 48.367 | 30.200 | 1.00 | 0.00 | XXXX | 2188 |
| ATOM | 2189 | O | ALA A | 293 | −7.218 | 49.270 | 29.390 | 1.00 | 0.00 | XXXX | 2189 |
| ATOM | 2190 | CB | ALA A | 293 | −9.760 | 47.491 | 30.434 | 1.00 | 0.00 | XXXX | 2190 |
| ATOM | 2191 | N | ALA A | 294 | −6.858 | 48.328 | 31.400 | 1.00 | 0.00 | XXXX | 2191 |
| ATOM | 2192 | CA | ALA A | 294 | −5.907 | 49.348 | 31.826 | 1.00 | 0.00 | XXXX | 2192 |
| ATOM | 2193 | C | ALA A | 294 | −4.660 | 49.290 | 30.951 | 1.00 | 0.00 | XXXX | 2193 |
| ATOM | 2194 | O | ALA A | 294 | −4.137 | 50.317 | 30.519 | 1.00 | 0.00 | XXXX | 2194 |
| ATOM | 2195 | CB | ALA A | 294 | −5.545 | 49.163 | 33.290 | 1.00 | 0.00 | XXXX | 2195 |
| ATOM | 2196 | N | TYR A | 295 | −4.194 | 48.071 | 30.703 | 1.00 | 0.00 | XXXX | 2196 |
| ATOM | 2197 | CA | TYR A | 295 | −3.043 | 47.819 | 29.844 | 1.00 | 0.00 | XXXX | 2197 |
| ATOM | 2198 | C | TYR A | 295 | −3.330 | 48.287 | 28.416 | 1.00 | 0.00 | XXXX | 2198 |
| ATOM | 2199 | O | TYR A | 295 | −2.535 | 49.013 | 27.815 | 1.00 | 0.00 | XXXX | 2199 |
| ATOM | 2200 | CB | TYR A | 295 | −2.695 | 46.327 | 29.879 | 1.00 | 0.00 | XXXX | 2200 |
| ATOM | 2201 | CG | TYR A | 295 | −1.568 | 45.897 | 28.968 | 1.00 | 0.00 | XXXX | 2201 |
| ATOM | 2202 | CD1 | TYR A | 295 | −1.829 | 45.325 | 27.730 | 1.00 | 0.00 | XXXX | 2202 |
| ATOM | 2203 | CD2 | TYR A | 295 | −0.244 | 46.036 | 29.360 | 1.00 | 0.00 | XXXX | 2203 |
| ATOM | 2204 | CE1 | TYR A | 295 | −0.800 | 44.918 | 26.900 | 1.00 | 0.00 | XXXX | 2204 |
| ATOM | 2205 | CE2 | TYR A | 295 | 0.791 | 45.632 | 28.537 | 1.00 | 0.00 | XXXX | 2205 |
| ATOM | 2206 | CZ | TYR A | 295 | 0.508 | 45.074 | 27.308 | 1.00 | 0.00 | XXXX | 2206 |
| ATOM | 2207 | OH | TYR A | 295 | 1.539 | 44.672 | 26.488 | 1.00 | 0.00 | XXXX | 2207 |
| ATOM | 2208 | N | ILE A | 296 | −4.471 | 47.862 | 27.882 | 1.00 | 0.00 | XXXX | 2208 |
| ATOM | 2209 | CA | ILE A | 296 | −4.932 | 48.283 | 26.560 | 1.00 | 0.00 | XXXX | 2209 |
| ATOM | 2210 | C | ILE A | 296 | −5.033 | 49.800 | 26.414 | 1.00 | 0.00 | XXXX | 2210 |
| ATOM | 2211 | O | ILE A | 296 | −4.621 | 50.362 | 25.399 | 1.00 | 0.00 | XXXX | 2211 |
| ATOM | 2212 | CB | ILE A | 296 | −6.313 | 47.679 | 26.235 | 1.00 | 0.00 | XXXX | 2212 |
| ATOM | 2213 | CG1 | ILE A | 296 | −6.176 | 46.217 | 25.809 | 1.00 | 0.00 | XXXX | 2213 |
| ATOM | 2214 | CG2 | ILE A | 296 | −7.013 | 48.492 | 25.154 | 1.00 | 0.00 | XXXX | 2214 |
| ATOM | 2215 | CD1 | ILE A | 296 | −7.498 | 45.567 | 25.476 | 1.00 | 0.00 | XXXX | 2215 |
| ATOM | 2216 | N | GLY A | 297 | −5.591 | 50.454 | 27.429 | 1.00 | 0.00 | XXXX | 2216 |
| ATOM | 2217 | CA | GLY A | 297 | −5.815 | 51.888 | 27.396 | 1.00 | 0.00 | XXXX | 2217 |
| ATOM | 2218 | C | GLY A | 297 | −4.565 | 52.712 | 27.149 | 1.00 | 0.00 | XXXX | 2218 |
| ATOM | 2219 | O | GLY A | 297 | −4.590 | 53.678 | 26.387 | 1.00 | 0.00 | XXXX | 2219 |
| ATOM | 2220 | N | VAL A | 298 | −3.469 | 52.334 | 27.799 | 1.00 | 0.00 | XXXX | 2220 |
| ATOM | 2221 | CA | VAL A | 298 | −2.203 | 53.033 | 27.619 | 1.00 | 0.00 | XXXX | 2221 |
| ATOM | 2222 | C | VAL A | 298 | −1.717 | 52.907 | 26.180 | 1.00 | 0.00 | XXXX | 2222 |
| ATOM | 2223 | O | VAL A | 298 | −1.292 | 53.889 | 25.571 | 1.00 | 0.00 | XXXX | 2223 |
| ATOM | 2224 | CB | VAL A | 298 | −1.119 | 52.498 | 28.571 | 1.00 | 0.00 | XXXX | 2224 |
| ATOM | 2225 | CG1 | VAL A | 298 | 0.225 | 53.152 | 28.269 | 1.00 | 0.00 | XXXX | 2225 |
| ATOM | 2226 | CG2 | VAL A | 298 | −1.523 | 52.734 | 30.019 | 1.00 | 0.00 | XXXX | 2226 |
| ATOM | 2227 | N | TYR A | 299 | −1.787 | 51.694 | 25.640 | 1.00 | 0.00 | XXXX | 2227 |
| ATOM | 2228 | CA | TYR A | 299 | −1.354 | 51.445 | 24.269 | 1.00 | 0.00 | XXXX | 2228 |
| ATOM | 2229 | C | TYR A | 299 | −2.208 | 52.186 | 23.247 | 1.00 | 0.00 | XXXX | 2229 |
| ATOM | 2230 | O | TYR A | 299 | −1.685 | 52.720 | 22.270 | 1.00 | 0.00 | XXXX | 2230 |
| ATOM | 2231 | CB | TYR A | 299 | −1.365 | 49.945 | 23.967 | 1.00 | 0.00 | XXXX | 2231 |
| ATOM | 2232 | CG | TYR A | 299 | −0.039 | 49.270 | 24.231 | 1.00 | 0.00 | XXXX | 2232 |
| ATOM | 2233 | CD1 | TYR A | 299 | 0.978 | 49.312 | 23.286 | 1.00 | 0.00 | XXXX | 2233 |
| ATOM | 2234 | CD2 | TYR A | 299 | 0.203 | 48.604 | 25.425 | 1.00 | 0.00 | XXXX | 2234 |
| ATOM | 2235 | CE1 | TYR A | 299 | 2.195 | 48.704 | 23.518 | 1.00 | 0.00 | XXXX | 2235 |
| ATOM | 2236 | CE2 | TYR A | 299 | 1.421 | 47.992 | 25.666 | 1.00 | 0.00 | XXXX | 2236 |
| ATOM | 2237 | CZ | TYR A | 299 | 2.413 | 48.046 | 24.708 | 1.00 | 0.00 | XXXX | 2237 |
| ATOM | 2238 | OH | TYR A | 299 | 3.629 | 47.442 | 24.935 | 1.00 | 0.00 | XXXX | 2238 |
| ATOM | 2239 | N | LEU A | 300 | −3.517 | 52.223 | 23.472 | 1.00 | 0.00 | XXXX | 2239 |
| ATOM | 2240 | CA | LEU A | 300 | −4.415 | 52.883 | 22.532 | 1.00 | 0.00 | XXXX | 2240 |
| ATOM | 2241 | C | LEU A | 300 | −4.236 | 54.398 | 22.557 | 1.00 | 0.00 | XXXX | 2241 |
| ATOM | 2242 | O | LEU A | 300 | −4.266 | 55.042 | 21.509 | 1.00 | 0.00 | XXXX | 2242 |
| ATOM | 2243 | CB | LEU A | 300 | −5.871 | 52.506 | 22.813 | 1.00 | 0.00 | XXXX | 2243 |
| ATOM | 2244 | CG | LEU A | 300 | −6.257 | 51.135 | 22.248 | 1.00 | 0.00 | XXXX | 2244 |
| ATOM | 2245 | CD1 | LEU A | 300 | −7.653 | 50.723 | 22.688 | 1.00 | 0.00 | XXXX | 2245 |
| ATOM | 2246 | CD2 | LEU A | 300 | −6.145 | 51.131 | 20.726 | 1.00 | 0.00 | XXXX | 2246 |
| ATOM | 2247 | N | TRP A | 301 | −4.059 | 54.968 | 23.746 | 1.00 | 0.00 | XXXX | 2247 |
| ATOM | 2248 | CA | TRP A | 301 | −3.746 | 56.390 | 23.846 | 1.00 | 0.00 | XXXX | 2248 |
| ATOM | 2249 | C | TRP A | 301 | −2.453 | 56.705 | 23.108 | 1.00 | 0.00 | XXXX | 2249 |
| ATOM | 2250 | O | TRP A | 301 | −2.381 | 57.667 | 22.344 | 1.00 | 0.00 | XXXX | 2250 |
| ATOM | 2251 | CB | TRP A | 301 | −3.620 | 56.840 | 25.301 | 1.00 | 0.00 | XXXX | 2251 |
| ATOM | 2252 | CG | TRP A | 301 | −3.024 | 58.216 | 25.412 | 1.00 | 0.00 | XXXX | 2252 |
| ATOM | 2253 | CD1 | TRP A | 301 | −3.670 | 59.405 | 25.236 | 1.00 | 0.00 | XXXX | 2253 |
| ATOM | 2254 | CD2 | TRP A | 301 | −1.656 | 58.542 | 25.697 | 1.00 | 0.00 | XXXX | 2254 |

-continued

| | | | | | | | | | | |
|---|---|---|---|---|---|---|---|---|---|---|
| ATOM | 2255 | NE1 | TRP A | 301 | −2.792 | 60.450 | 25.402 | 1.00 | 0.00 | XXXX | 2255 |
| ATOM | 2256 | CE2 | TRP A | 301 | −1.551 | 59.947 | 25.688 | 1.00 | 0.00 | XXXX | 2256 |
| ATOM | 2257 | CE3 | TRP A | 301 | −0.514 | 57.782 | 25.965 | 1.00 | 0.00 | XXXX | 2257 |
| ATOM | 2258 | CZ2 | TRP A | 301 | −0.348 | 60.608 | 25.936 | 1.00 | 0.00 | XXXX | 2258 |
| ATOM | 2259 | CZ3 | TRP A | 301 | 0.679 | 58.440 | 26.211 | 1.00 | 0.00 | XXXX | 2259 |
| ATOM | 2260 | CH2 | TRP A | 301 | 0.753 | 59.839 | 26.195 | 1.00 | 0.00 | XXXX | 2260 |
| ATOM | 2261 | N | ALA A | 302 | −1.432 | 55.890 | 23.351 | 1.00 | 0.00 | XXXX | 2261 |
| ATOM | 2262 | CA | ALA A | 302 | −0.124 | 56.101 | 22.744 | 1.00 | 0.00 | XXXX | 2262 |
| ATOM | 2263 | C | ALA A | 302 | −0.209 | 55.996 | 21.225 | 1.00 | 0.00 | XXXX | 2263 |
| ATOM | 2264 | O | ALA A | 302 | 0.421 | 56.773 | 20.507 | 1.00 | 0.00 | XXXX | 2264 |
| ATOM | 2265 | CB | ALA A | 302 | 0.886 | 55.103 | 23.294 | 1.00 | 0.00 | XXXX | 2265 |
| ATOM | 2266 | N | LYS A | 303 | −0.996 | 55.038 | 20.741 | 1.00 | 0.00 | XXXX | 2266 |
| ATOM | 2267 | CA | LYS A | 303 | −1.204 | 54.871 | 19.306 | 1.00 | 0.00 | XXXX | 2267 |
| ATOM | 2268 | C | LYS A | 303 | −1.929 | 56.070 | 18.702 | 1.00 | 0.00 | XXXX | 2268 |
| ATOM | 2269 | O | LYS A | 303 | −1.607 | 56.507 | 17.597 | 1.00 | 0.00 | XXXX | 2269 |
| ATOM | 2270 | CB | LYS A | 303 | −1.988 | 53.587 | 19.021 | 1.00 | 0.00 | XXXX | 2270 |
| ATOM | 2271 | CG | LYS A | 303 | −1.216 | 52.312 | 19.318 | 1.00 | 0.00 | XXXX | 2271 |
| ATOM | 2272 | CD | LYS A | 303 | −1.974 | 51.087 | 18.838 | 1.00 | 0.00 | XXXX | 2272 |
| ATOM | 2273 | CE | LYS A | 303 | −2.145 | 51.111 | 17.328 | 1.00 | 0.00 | XXXX | 2273 |
| ATOM | 2274 | NZ | LYS A | 303 | −2.680 | 49.828 | 16.805 | 1.00 | 0.00 | XXXX | 2274 |
| ATOM | 2275 | N | ALA A | 304 | −2.908 | 56.597 | 19.430 | 1.00 | 0.00 | XXXX | 2275 |
| ATOM | 2276 | CA | ALA A | 304 | −3.644 | 57.772 | 18.979 | 1.00 | 0.00 | XXXX | 2276 |
| ATOM | 2277 | C | ALA A | 304 | −2.720 | 58.984 | 18.905 | 1.00 | 0.00 | XXXX | 2277 |
| ATOM | 2278 | O | ALA A | 304 | −2.804 | 59.786 | 17.976 | 1.00 | 0.00 | XXXX | 2278 |
| ATOM | 2279 | CB | ALA A | 304 | −4.822 | 58.053 | 19.899 | 1.00 | 0.00 | XXXX | 2279 |
| ATOM | 2280 | N | VAL A | 305 | −1.837 | 59.106 | 19.892 | 1.00 | 0.00 | XXXX | 2280 |
| ATOM | 2281 | CA | VAL A | 305 | −0.860 | 60.190 | 19.922 | 1.00 | 0.00 | XXXX | 2281 |
| ATOM | 2282 | C | VAL A | 305 | 0.122 | 60.078 | 18.760 | 1.00 | 0.00 | XXXX | 2282 |
| ATOM | 2283 | O | VAL A | 305 | 0.396 | 61.060 | 18.068 | 1.00 | 0.00 | XXXX | 2283 |
| ATOM | 2284 | CB | VAL A | 305 | −0.073 | 60.201 | 21.246 | 1.00 | 0.00 | XXXX | 2284 |
| ATOM | 2285 | CG1 | VAL A | 305 | 1.135 | 61.120 | 21.141 | 1.00 | 0.00 | XXXX | 2285 |
| ATOM | 2286 | CG2 | VAL A | 305 | −0.977 | 60.622 | 22.395 | 1.00 | 0.00 | XXXX | 2286 |
| ATOM | 2287 | N | GLU A | 306 | 0.651 | 58.876 | 18.555 | 1.00 | 0.00 | XXXX | 2287 |
| ATOM | 2288 | CA | GLU A | 306 | 1.550 | 58.605 | 17.438 | 1.00 | 0.00 | XXXX | 2288 |
| ATOM | 2289 | C | GLU A | 306 | 0.916 | 58.965 | 16.098 | 1.00 | 0.00 | XXXX | 2289 |
| ATOM | 2290 | O | GLU A | 306 | 1.546 | 59.599 | 15.251 | 1.00 | 0.00 | XXXX | 2290 |
| ATOM | 2291 | CB | GLU A | 306 | 1.973 | 57.136 | 17.442 | 1.00 | 0.00 | XXXX | 2291 |
| ATOM | 2292 | CG | GLU A | 306 | 3.115 | 56.840 | 18.392 | 1.00 | 0.00 | XXXX | 2292 |
| ATOM | 2293 | CD | GLU A | 306 | 4.383 | 57.557 | 17.986 | 1.00 | 0.00 | XXXX | 2293 |
| ATOM | 2294 | OE1 | GLU A | 306 | 4.618 | 57.674 | 16.767 | 1.00 | 0.00 | XXXX | 2294 |
| ATOM | 2295 | OE2 | GLU A | 306 | 5.135 | 58.009 | 18.874 | 1.00 | 0.00 | XXXX | 2295 |
| ATOM | 2296 | N | LYS A | 307 | −0.332 | 58.550 | 15.915 | 1.00 | 0.00 | XXXX | 2296 |
| ATOM | 2297 | CA | LYS A | 307 | −1.061 | 58.813 | 14.681 | 1.00 | 0.00 | XXXX | 2297 |
| ATOM | 2298 | C | LYS A | 307 | −1.351 | 60.302 | 14.517 | 1.00 | 0.00 | XXXX | 2298 |
| ATOM | 2299 | O | LYS A | 307 | −1.240 | 60.848 | 13.418 | 1.00 | 0.00 | XXXX | 2299 |
| ATOM | 2300 | CB | LYS A | 307 | −2.364 | 58.012 | 14.659 | 1.00 | 0.00 | XXXX | 2300 |
| ATOM | 2301 | CG | LYS A | 307 | −3.231 | 58.247 | 13.436 | 1.00 | 0.00 | XXXX | 2301 |
| ATOM | 2302 | CD | LYS A | 307 | −4.505 | 57.423 | 13.513 | 1.00 | 0.00 | XXXX | 2302 |
| ATOM | 2303 | CE | LYS A | 307 | −5.533 | 57.889 | 12.499 | 1.00 | 0.00 | XXXX | 2303 |
| ATOM | 2304 | NZ | LYS A | 307 | −6.840 | 57.203 | 12.698 | 1.00 | 0.00 | XXXX | 2304 |
| ATOM | 2305 | N | ALA A | 308 | −1.716 | 60.953 | 15.617 | 1.00 | 0.00 | XXXX | 2305 |
| ATOM | 2306 | CA | ALA A | 308 | −2.026 | 62.378 | 15.599 | 1.00 | 0.00 | XXXX | 2306 |
| ATOM | 2307 | C | ALA A | 308 | −0.774 | 63.233 | 15.417 | 1.00 | 0.00 | XXXX | 2307 |
| ATOM | 2308 | O | ALA A | 308 | −0.851 | 64.361 | 14.929 | 1.00 | 0.00 | XXXX | 2308 |
| ATOM | 2309 | CB | ALA A | 308 | −2.752 | 62.775 | 16.877 | 1.00 | 0.00 | XXXX | 2309 |
| ATOM | 2310 | N | GLY A | 309 | 0.376 | 62.697 | 15.811 | 1.00 | 0.00 | XXXX | 2310 |
| ATOM | 2311 | CA | GLY A | 309 | 1.614 | 63.453 | 15.776 | 1.00 | 0.00 | XXXX | 2311 |
| ATOM | 2312 | C | GLY A | 309 | 1.640 | 64.531 | 16.845 | 1.00 | 0.00 | XXXX | 2312 |
| ATOM | 2313 | O | GLY A | 309 | 2.423 | 65.477 | 16.769 | 1.00 | 0.00 | XXXX | 2313 |
| ATOM | 2314 | N | SER A | 310 | 0.776 | 64.383 | 17.844 | 1.00 | 0.00 | XXXX | 2314 |
| ATOM | 2315 | CA | SER A | 310 | 0.624 | 65.387 | 18.889 | 1.00 | 0.00 | XXXX | 2315 |
| ATOM | 2316 | C | SER A | 310 | −0.126 | 64.810 | 20.083 | 1.00 | 0.00 | XXXX | 2316 |
| ATOM | 2317 | O | SER A | 310 | −0.924 | 63.886 | 19.936 | 1.00 | 0.00 | XXXX | 2317 |
| ATOM | 2318 | CB | SER A | 310 | −0.111 | 66.616 | 18.347 | 1.00 | 0.00 | XXXX | 2318 |
| ATOM | 2319 | OG | SER A | 310 | −0.331 | 67.579 | 19.368 | 1.00 | 0.00 | XXXX | 2319 |
| ATOM | 2320 | N | THR A | 311 | 0.138 | 65.356 | 21.265 | 1.00 | 0.00 | XXXX | 2320 |
| ATOM | 2321 | CA | THR A | 311 | −0.593 | 64.969 | 22.464 | 1.00 | 0.00 | XXXX | 2321 |
| ATOM | 2322 | C | THR A | 311 | −1.816 | 65.860 | 22.654 | 1.00 | 0.00 | XXXX | 2322 |
| ATOM | 2323 | O | THR A | 311 | −2.598 | 65.665 | 23.586 | 1.00 | 0.00 | XXXX | 2323 |
| ATOM | 2324 | CB | THR A | 311 | 0.294 | 65.046 | 23.719 | 1.00 | 0.00 | XXXX | 2324 |
| ATOM | 2325 | OG1 | THR A | 311 | 0.746 | 66.392 | 23.905 | 1.00 | 0.00 | XXXX | 2325 |
| ATOM | 2326 | CG2 | THR A | 311 | 1.496 | 64.126 | 23.578 | 1.00 | 0.00 | XXXX | 2326 |
| ATOM | 2327 | N | ASP A | 312 | −1.968 | 66.844 | 21.771 | 1.00 | 0.00 | XXXX | 2327 |
| ATOM | 2328 | CA | ASP A | 312 | −3.124 | 67.736 | 21.801 | 1.00 | 0.00 | XXXX | 2328 |
| ATOM | 2329 | C | ASP A | 312 | −4.421 | 66.934 | 21.807 | 1.00 | 0.00 | XXXX | 2329 |
| ATOM | 2330 | O | ASP A | 312 | −4.637 | 66.080 | 20.946 | 1.00 | 0.00 | XXXX | 2330 |
| ATOM | 2331 | CB | ASP A | 312 | −3.099 | 68.697 | 20.610 | 1.00 | 0.00 | XXXX | 2331 |
| ATOM | 2332 | CG | ASP A | 312 | −4.318 | 69.597 | 20.564 | 1.00 | 0.00 | XXXX | 2332 |
| ATOM | 2333 | OD1 | ASP A | 312 | −4.348 | 70.598 | 21.311 | 1.00 | 0.00 | XXXX | 2333 |

-continued

| | | | | | | | | | |
|---|---|---|---|---|---|---|---|---|---|
| ATOM | 2334 | OD2 | ASP A | 312 | −5.248 | 69.304 | 19.783 | 1.00 | 0.00 XXXX 2334 |
| ATOM | 2335 | N | VAL A | 313 | −5.279 | 67.218 | 22.783 | 1.00 | 0.00 XXXX 2335 |
| ATOM | 2336 | CA | VAL A | 313 | −6.462 | 66.402 | 23.042 | 1.00 | 0.00 XXXX 2336 |
| ATOM | 2337 | C | VAL A | 313 | −7.408 | 66.319 | 21.846 | 1.00 | 0.00 XXXX 2337 |
| ATOM | 2338 | O | VAL A | 313 | −7.921 | 65.246 | 21.530 | 1.00 | 0.00 XXXX 2338 |
| ATOM | 2339 | CB | VAL A | 313 | −7.247 | 66.934 | 24.258 | 1.00 | 0.00 XXXX 2339 |
| ATOM | 2340 | CG1 | VAL A | 313 | −8.644 | 66.332 | 24.296 | 1.00 | 0.00 XXXX 2340 |
| ATOM | 2341 | CG2 | VAL A | 313 | −6.497 | 66.627 | 25.545 | 1.00 | 0.00 XXXX 2341 |
| ATOM | 2342 | N | ASP A | 314 | −7.642 | 67.448 | 21.184 | 1.00 | 0.00 XXXX 2342 |
| ATOM | 2343 | CA | ASP A | 314 | −8.544 | 67.470 | 20.036 | 1.00 | 0.00 XXXX 2343 |
| ATOM | 2344 | C | ASP A | 314 | −8.019 | 66.622 | 18.881 | 1.00 | 0.00 XXXX 2344 |
| ATOM | 2345 | O | ASP A | 314 | −8.789 | 65.950 | 18.196 | 1.00 | 0.00 XXXX 2345 |
| ATOM | 2346 | CB | ASP A | 314 | −8.781 | 68.907 | 19.565 | 1.00 | 0.00 XXXX 2346 |
| ATOM | 2347 | CG | ASP A | 314 | −9.575 | 69.726 | 20.565 | 1.00 | 0.00 XXXX 2347 |
| ATOM | 2348 | OD1 | ASP A | 314 | −10.291 | 69.127 | 21.396 | 1.00 | 0.00 XXXX 2348 |
| ATOM | 2349 | OD2 | ASP A | 314 | −9.491 | 70.971 | 20.516 | 1.00 | 0.00 XXXX 2349 |
| ATOM | 2350 | N | LYS A | 315 | −6.709 | 66.657 | 18.665 | 1.00 | 0.00 XXXX 2350 |
| ATOM | 2351 | CA | LYS A | 315 | −6.094 | 65.859 | 17.610 | 1.00 | 0.00 XXXX 2351 |
| ATOM | 2352 | C | LYS A | 315 | −6.078 | 64.376 | 17.970 | 1.00 | 0.00 XXXX 2352 |
| ATOM | 2353 | O | LYS A | 315 | −6.306 | 63.519 | 17.116 | 1.00 | 0.00 XXXX 2353 |
| ATOM | 2354 | CB | LYS A | 315 | −4.678 | 66.356 | 17.325 | 1.00 | 0.00 XXXX 2354 |
| ATOM | 2355 | CG | LYS A | 315 | −4.641 | 67.760 | 16.752 | 1.00 | 0.00 XXXX 2355 |
| ATOM | 2356 | CD | LYS A | 315 | −3.218 | 68.258 | 16.593 | 1.00 | 0.00 XXXX 2356 |
| ATOM | 2357 | CE | LYS A | 315 | −3.199 | 69.677 | 16.049 | 1.00 | 0.00 XXXX 2357 |
| ATOM | 2358 | NZ | LYS A | 315 | −1.816 | 70.162 | 15.791 | 1.00 | 0.00 XXXX 2358 |
| ATOM | 2359 | N | VAL A | 316 | −5.805 | 64.082 | 19.237 | 1.00 | 0.00 XXXX 2359 |
| ATOM | 2360 | CA | VAL A | 316 | −5.798 | 62.706 | 19.717 | 1.00 | 0.00 XXXX 2360 |
| ATOM | 2361 | C | VAL A | 316 | −7.189 | 62.092 | 19.600 | 1.00 | 0.00 XXXX 2361 |
| ATOM | 2362 | O | VAL A | 316 | −7.331 | 60.937 | 19.201 | 1.00 | 0.00 XXXX 2362 |
| ATOM | 2363 | CB | VAL A | 316 | −5.321 | 62.613 | 21.177 | 1.00 | 0.00 XXXX 2363 |
| ATOM | 2364 | CG1 | VAL A | 316 | −5.593 | 61.224 | 21.735 | 1.00 | 0.00 XXXX 2364 |
| ATOM | 2365 | CG2 | VAL A | 316 | −3.838 | 62.953 | 21.274 | 1.00 | 0.00 XXXX 2365 |
| ATOM | 2366 | N | ARG A | 317 | −8.211 | 62.866 | 19.959 | 1.00 | 0.00 XXXX 2366 |
| ATOM | 2367 | CA | ARG A | 317 | −9.591 | 62.403 | 19.862 | 1.00 | 0.00 XXXX 2367 |
| ATOM | 2368 | C | ARG A | 317 | −9.950 | 62.024 | 18.429 | 1.00 | 0.00 XXXX 2368 |
| ATOM | 2369 | O | ARG A | 317 | −10.586 | 60.997 | 18.188 | 1.00 | 0.00 XXXX 2369 |
| ATOM | 2370 | CB | ARG A | 317 | −10.559 | 63.472 | 20.375 | 1.00 | 0.00 XXXX 2370 |
| ATOM | 2371 | CG | ARG A | 317 | −12.003 | 63.000 | 20.424 | 1.00 | 0.00 XXXX 2371 |
| ATOM | 2372 | CD | ARG A | 317 | −12.963 | 64.105 | 20.837 | 1.00 | 0.00 XXXX 2372 |
| ATOM | 2373 | NE | ARG A | 317 | −12.660 | 64.645 | 22.158 | 1.00 | 0.00 XXXX 2373 |
| ATOM | 2374 | CZ | ARG A | 317 | −12.020 | 65.790 | 22.369 | 1.00 | 0.00 XXXX 2374 |
| ATOM | 2375 | NH1 | ARG A | 317 | −11.617 | 66.526 | 21.344 | 1.00 | 0.00 XXXX 2375 |
| ATOM | 2376 | NH2 | ARG A | 317 | −11.789 | 66.202 | 23.608 | 1.00 | 0.00 XXXX 2376 |
| ATOM | 2377 | N | GLU A | 318 | −9.544 | 62.862 | 17.482 | 1.00 | 0.00 XXXX 2377 |
| ATOM | 2378 | CA | GLU A | 318 | −9.820 | 62.616 | 16.073 | 1.00 | 0.00 XXXX 2378 |
| ATOM | 2379 | C | GLU A | 318 | −9.072 | 61.387 | 15.569 | 1.00 | 0.00 XXXX 2379 |
| ATOM | 2380 | O | GLU A | 318 | −9.643 | 60.536 | 14.887 | 1.00 | 0.00 XXXX 2380 |
| ATOM | 2381 | CB | GLU A | 318 | −9.448 | 63.839 | 15.233 | 1.00 | 0.00 XXXX 2381 |
| ATOM | 2382 | CG | GLU A | 318 | −9.663 | 63.650 | 13.739 | 1.00 | 0.00 XXXX 2382 |
| ATOM | 2383 | CD | GLU A | 318 | −11.099 | 63.302 | 13.397 | 1.00 | 0.00 XXXX 2383 |
| ATOM | 2384 | OE1 | GLU A | 318 | −12.010 | 63.752 | 14.123 | 1.00 | 0.00 XXXX 2384 |
| ATOM | 2385 | OE2 | GLU A | 318 | −11.317 | 62.574 | 12.404 | 1.00 | 0.00 XXXX 2385 |
| ATOM | 2386 | N | ALA A | 319 | −7.792 | 61.298 | 15.915 | 1.00 | 0.00 XXXX 2386 |
| ATOM | 2387 | CA | ALA A | 319 | −6.950 | 60.191 | 15.478 | 1.00 | 0.00 XXXX 2387 |
| ATOM | 2388 | C | ALA A | 319 | −7.390 | 58.861 | 16.085 | 1.00 | 0.00 XXXX 2388 |
| ATOM | 2389 | O | ALA A | 319 | −7.225 | 57.806 | 15.475 | 1.00 | 0.00 XXXX 2389 |
| ATOM | 2390 | CB | ALA A | 319 | −5.497 | 60.469 | 15.828 | 1.00 | 0.00 XXXX 2390 |
| ATOM | 2391 | N | ALA A | 320 | −7.949 | 58.919 | 17.289 | 1.00 | 0.00 XXXX 2391 |
| ATOM | 2392 | CA | ALA A | 320 | −8.307 | 57.711 | 18.025 | 1.00 | 0.00 XXXX 2392 |
| ATOM | 2393 | C | ALA A | 320 | −9.453 | 56.947 | 17.369 | 1.00 | 0.00 XXXX 2393 |
| ATOM | 2394 | O | ALA A | 320 | −9.579 | 55.737 | 17.554 | 1.00 | 0.00 XXXX 2394 |
| ATOM | 2395 | CB | ALA A | 320 | −8.667 | 58.061 | 19.461 | 1.00 | 0.00 XXXX 2395 |
| ATOM | 2396 | N | LYS A | 321 | −10.284 | 57.654 | 16.609 | 1.00 | 0.00 XXXX 2396 |
| ATOM | 2397 | CA | LYS A | 321 | −11.444 | 57.039 | 15.969 | 1.00 | 0.00 XXXX 2397 |
| ATOM | 2398 | C | LYS A | 321 | −11.055 | 55.886 | 15.049 | 1.00 | 0.00 XXXX 2398 |
| ATOM | 2399 | O | LYS A | 321 | −10.338 | 56.075 | 14.066 | 1.00 | 0.00 XXXX 2399 |
| ATOM | 2400 | CB | LYS A | 321 | −12.235 | 58.082 | 15.175 | 1.00 | 0.00 XXXX 2400 |
| ATOM | 2401 | CG | LYS A | 321 | −12.812 | 59.209 | 16.012 | 1.00 | 0.00 XXXX 2401 |
| ATOM | 2402 | CD | LYS A | 321 | −13.652 | 60.146 | 15.160 | 1.00 | 0.00 XXXX 2402 |
| ATOM | 2403 | CE | LYS A | 321 | −14.200 | 61.302 | 15.978 | 1.00 | 0.00 XXXX 2403 |
| ATOM | 2404 | NZ | LYS A | 321 | −14.912 | 62.288 | 15.121 | 1.00 | 0.00 XXXX 2404 |
| ATOM | 2405 | N | GLY A | 322 | −11.539 | 54.692 | 15.375 | 1.00 | 0.00 XXXX 2405 |
| ATOM | 2406 | CA | GLY A | 322 | −11.322 | 53.524 | 14.542 | 1.00 | 0.00 XXXX 2406 |
| ATOM | 2407 | C | GLY A | 322 | −10.011 | 52.792 | 14.766 | 1.00 | 0.00 XXXX 2407 |
| ATOM | 2408 | O | GLY A | 322 | −9.758 | 51.771 | 14.125 | 1.00 | 0.00 XXXX 2408 |
| ATOM | 2409 | N | ILE A | 323 | −9.174 | 53.297 | 15.668 | 1.00 | 0.00 XXXX 2409 |
| ATOM | 2410 | CA | ILE A | 323 | −7.888 | 52.652 | 15.927 | 1.00 | 0.00 XXXX 2410 |
| ATOM | 2411 | C | ILE A | 323 | −8.074 | 51.263 | 16.522 | 1.00 | 0.00 XXXX 2411 |
| ATOM | 2412 | O | ILE A | 323 | −8.853 | 51.068 | 17.458 | 1.00 | 0.00 XXXX 2412 |

-continued

| | | | | | | | | | | |
|---|---|---|---|---|---|---|---|---|---|---|
| ATOM | 2413 | CB | ILE A | 323 | −6.998 | 53.486 | 16.865 | 1.00 | 0.00 | XXXX | 2413 |
| ATOM | 2414 | CG1 | ILE A | 323 | −6.469 | 54.719 | 16.133 | 1.00 | 0.00 | XXXX | 2414 |
| ATOM | 2415 | CD1 | ILE A | 323 | −5.398 | 55.468 | 16.899 | 1.00 | 0.00 | XXXX | 2415 |
| ATOM | 2416 | CG2 | ILE A | 323 | −5.820 | 52.657 | 17.353 | 1.00 | 0.00 | XXXX | 2416 |
| ATOM | 2417 | N | GLU A | 324 | −7.346 | 50.301 | 15.965 | 1.00 | 0.00 | XXXX | 2417 |
| ATOM | 2418 | CA | GLU A | 324 | −7.446 | 48.907 | 16.374 | 1.00 | 0.00 | XXXX | 2418 |
| ATOM | 2419 | C | GLU A | 324 | −6.300 | 48.498 | 17.293 | 1.00 | 0.00 | XXXX | 2419 |
| ATOM | 2420 | O | GLU A | 324 | −5.287 | 49.191 | 17.391 | 1.00 | 0.00 | XXXX | 2420 |
| ATOM | 2421 | CB | GLU A | 324 | −7.472 | 47.998 | 15.144 | 1.00 | 0.00 | XXXX | 2421 |
| ATOM | 2422 | CG | GLU A | 324 | −8.600 | 48.302 | 14.175 | 1.00 | 0.00 | XXXX | 2422 |
| ATOM | 2423 | CD | GLU A | 324 | −8.422 | 47.604 | 12.842 | 1.00 | 0.00 | XXXX | 2423 |
| ATOM | 2424 | OE1 | GLU A | 324 | −7.262 | 47.356 | 12.452 | 1.00 | 0.00 | XXXX | 2424 |
| ATOM | 2425 | OE2 | GLU A | 324 | −9.440 | 47.304 | 12.184 | 1.00 | 0.00 | XXXX | 2425 |
| ATOM | 2426 | N | PHE A | 325 | −6.475 | 47.370 | 17.972 | 1.00 | 0.00 | XXXX | 2426 |
| ATOM | 2427 | CA | PHE A | 325 | −5.423 | 46.798 | 18.802 | 1.00 | 0.00 | XXXX | 2427 |
| ATOM | 2428 | C | PHE A | 325 | −5.616 | 45.292 | 18.937 | 1.00 | 0.00 | XXXX | 2428 |
| ATOM | 2429 | O | PHE A | 325 | −6.718 | 44.822 | 19.222 | 1.00 | 0.00 | XXXX | 2429 |
| ATOM | 2430 | CB | PHE A | 325 | −5.406 | 47.459 | 20.183 | 1.00 | 0.00 | XXXX | 2430 |
| ATOM | 2431 | CG | PHE A | 325 | −4.209 | 47.093 | 21.017 | 1.00 | 0.00 | XXXX | 2431 |
| ATOM | 2432 | CD1 | PHE A | 325 | −2.961 | 47.624 | 20.734 | 1.00 | 0.00 | XXXX | 2432 |
| ATOM | 2433 | CD2 | PHE A | 325 | −4.331 | 46.215 | 22.081 | 1.00 | 0.00 | XXXX | 2433 |
| ATOM | 2434 | CE1 | PHE A | 325 | −1.857 | 47.288 | 21.498 | 1.00 | 0.00 | XXXX | 2434 |
| ATOM | 2435 | CE2 | PHE A | 325 | −3.232 | 45.876 | 22.850 | 1.00 | 0.00 | XXXX | 2435 |
| ATOM | 2436 | CZ | PHE A | 325 | −1.994 | 46.412 | 22.558 | 1.00 | 0.00 | XXXX | 2436 |
| ATOM | 2437 | N | ASN A | 326 | −4.544 | 44.535 | 18.726 | 1.00 | 0.00 | XXXX | 2437 |
| ATOM | 2438 | CA | ASN A | 326 | −4.591 | 43.094 | 18.940 | 1.00 | 0.00 | XXXX | 2438 |
| ATOM | 2439 | C | ASN A | 326 | −4.482 | 42.775 | 20.428 | 1.00 | 0.00 | XXXX | 2439 |
| ATOM | 2440 | O | ASN A | 326 | −3.424 | 42.383 | 20.917 | 1.00 | 0.00 | XXXX | 2440 |
| ATOM | 2441 | CB | ASN A | 326 | −3.480 | 42.391 | 18.156 | 1.00 | 0.00 | XXXX | 2441 |
| ATOM | 2442 | CG | ASN A | 326 | −2.127 | 43.052 | 18.336 | 1.00 | 0.00 | XXXX | 2442 |
| ATOM | 2443 | OD1 | ASN A | 326 | −2.022 | 44.278 | 18.388 | 1.00 | 0.00 | XXXX | 2443 |
| ATOM | 2444 | ND2 | ASN A | 326 | −1.080 | 42.239 | 18.440 | 1.00 | 0.00 | XXXX | 2444 |
| ATOM | 2445 | N | ALA A | 327 | −5.594 | 42.938 | 21.138 | 1.00 | 0.00 | XXXX | 2445 |
| ATOM | 2446 | CA | ALA A | 327 | −5.622 | 42.752 | 22.584 | 1.00 | 0.00 | XXXX | 2446 |
| ATOM | 2447 | C | ALA A | 327 | −5.564 | 41.281 | 22.967 | 1.00 | 0.00 | XXXX | 2447 |
| ATOM | 2448 | O | ALA A | 327 | −5.881 | 40.410 | 22.159 | 1.00 | 0.00 | XXXX | 2448 |
| ATOM | 2449 | CB | ALA A | 327 | −6.868 | 43.397 | 23.176 | 1.00 | 0.00 | XXXX | 2449 |
| ATOM | 2450 | N | PRO A | 328 | −5.150 | 41.003 | 24.210 | 1.00 | 0.00 | XXXX | 2450 |
| ATOM | 2451 | CA | PRO A | 328 | −5.137 | 39.655 | 24.785 | 1.00 | 0.00 | XXXX | 2451 |
| ATOM | 2452 | C | PRO A | 328 | −6.491 | 38.956 | 24.665 | 1.00 | 0.00 | XXXX | 2452 |
| ATOM | 2453 | O | PRO A | 328 | −6.537 | 37.743 | 24.469 | 1.00 | 0.00 | XXXX | 2453 |
| ATOM | 2454 | CB | PRO A | 328 | −4.780 | 39.910 | 26.251 | 1.00 | 0.00 | XXXX | 2454 |
| ATOM | 2455 | CG | PRO A | 328 | −3.953 | 41.147 | 26.208 | 1.00 | 0.00 | XXXX | 2455 |
| ATOM | 2456 | CD | PRO A | 328 | −4.581 | 41.998 | 25.137 | 1.00 | 0.00 | XXXX | 2456 |
| ATOM | 2457 | N | GLU A | 329 | −7.576 | 39.715 | 24.786 | 1.00 | 0.00 | XXXX | 2457 |
| ATOM | 2458 | CA | GLU A | 329 | −8.917 | 39.140 | 24.743 | 1.00 | 0.00 | XXXX | 2458 |
| ATOM | 2459 | C | GLU A | 329 | −9.340 | 38.815 | 23.315 | 1.00 | 0.00 | XXXX | 2459 |
| ATOM | 2460 | O | GLU A | 329 | −10.276 | 38.046 | 23.088 | 1.00 | 0.00 | XXXX | 2460 |
| ATOM | 2461 | CB | GLU A | 329 | −9.933 | 40.101 | 25.362 | 1.00 | 0.00 | XXXX | 2461 |
| ATOM | 2462 | CG | GLU A | 329 | −10.208 | 41.323 | 24.494 | 1.00 | 0.00 | XXXX | 2462 |
| ATOM | 2463 | CD | GLU A | 329 | −11.387 | 42.143 | 24.983 | 1.00 | 0.00 | XXXX | 2463 |
| ATOM | 2464 | OE1 | GLU A | 329 | −11.285 | 42.752 | 26.069 | 1.00 | 0.00 | XXXX | 2464 |
| ATOM | 2465 | OE2 | GLU A | 329 | −12.417 | 42.178 | 24.278 | 1.00 | 0.00 | XXXX | 2465 |
| ATOM | 2466 | N | GLY A | 330 | −8.641 | 39.408 | 22.356 | 1.00 | 0.00 | XXXX | 2466 |
| ATOM | 2467 | CA | GLY A | 330 | −9.031 | 39.329 | 20.962 | 1.00 | 0.00 | XXXX | 2467 |
| ATOM | 2468 | C | GLY A | 330 | −8.980 | 40.713 | 20.348 | 1.00 | 0.00 | XXXX | 2468 |
| ATOM | 2469 | O | GLY A | 330 | −8.544 | 41.664 | 20.997 | 1.00 | 0.00 | XXXX | 2469 |
| ATOM | 2470 | N | PRO A | 331 | −9.428 | 40.841 | 19.092 | 1.00 | 0.00 | XXXX | 2470 |
| ATOM | 2471 | CA | PRO A | 331 | −9.371 | 42.152 | 18.440 | 1.00 | 0.00 | XXXX | 2471 |
| ATOM | 2472 | C | PRO A | 331 | −10.318 | 43.163 | 19.079 | 1.00 | 0.00 | XXXX | 2472 |
| ATOM | 2473 | O | PRO A | 331 | −11.483 | 42.854 | 19.328 | 1.00 | 0.00 | XXXX | 2473 |
| ATOM | 2474 | CB | PRO A | 331 | −9.791 | 41.848 | 16.999 | 1.00 | 0.00 | XXXX | 2474 |
| ATOM | 2475 | CG | PRO A | 331 | −10.605 | 40.602 | 17.097 | 1.00 | 0.00 | XXXX | 2475 |
| ATOM | 2476 | CD | PRO A | 331 | −10.007 | 39.805 | 18.219 | 1.00 | 0.00 | XXXX | 2476 |
| ATOM | 2477 | N | VAL A | 332 | −9.808 | 44.360 | 19.342 | 1.00 | 0.00 | XXXX | 2477 |
| ATOM | 2478 | CA | VAL A | 332 | −10.634 | 45.461 | 19.814 | 1.00 | 0.00 | XXXX | 2478 |
| ATOM | 2479 | C | VAL A | 332 | −10.404 | 46.682 | 18.935 | 1.00 | 0.00 | XXXX | 2479 |
| ATOM | 2480 | O | VAL A | 332 | −9.462 | 46.718 | 18.143 | 1.00 | 0.00 | XXXX | 2480 |
| ATOM | 2481 | CB | VAL A | 332 | −10.335 | 45.822 | 21.283 | 1.00 | 0.00 | XXXX | 2481 |
| ATOM | 2482 | CG1 | VAL A | 332 | −10.625 | 44.637 | 22.193 | 1.00 | 0.00 | XXXX | 2482 |
| ATOM | 2483 | CG2 | VAL A | 332 | −8.891 | 46.289 | 21.435 | 1.00 | 0.00 | XXXX | 2483 |
| ATOM | 2484 | N | LYS A | 333 | −11.269 | 47.677 | 19.078 | 1.00 | 0.00 | XXXX | 2484 |
| ATOM | 2485 | CA | LYS A | 333 | −11.188 | 48.884 | 18.269 | 1.00 | 0.00 | XXXX | 2485 |
| ATOM | 2486 | C | LYS A | 333 | −11.925 | 50.015 | 18.969 | 1.00 | 0.00 | XXXX | 2486 |
| ATOM | 2487 | O | LYS A | 333 | −12.974 | 49.797 | 19.574 | 1.00 | 0.00 | XXXX | 2487 |
| ATOM | 2488 | CB | LYS A | 333 | −11.781 | 48.663 | 16.876 | 1.00 | 0.00 | XXXX | 2488 |
| ATOM | 2489 | CG | LYS A | 333 | −11.893 | 49.949 | 16.070 | 1.00 | 0.00 | XXXX | 2489 |
| ATOM | 2490 | CD | LYS A | 333 | −12.822 | 49.816 | 14.877 | 1.00 | 0.00 | XXXX | 2490 |
| ATOM | 2491 | CE | LYS A | 333 | −14.231 | 50.257 | 15.243 | 1.00 | 0.00 | XXXX | 2491 |

| | | | | | | | | | | |
|---|---|---|---|---|---|---|---|---|---|---|
| ATOM | 2492 | NZ | LYS A | 333 | −15.083 | 50.492 | 14.045 | 1.00 | 0.00 | XXXX | 2492 |
| ATOM | 2493 | N | ILE A | 334 | −11.380 | 51.222 | 18.890 | 1.00 | 0.00 | XXXX | 2493 |
| ATOM | 2494 | CA | ILE A | 334 | −12.067 | 52.373 | 19.454 | 1.00 | 0.00 | XXXX | 2494 |
| ATOM | 2495 | C | ILE A | 334 | −13.229 | 52.767 | 18.551 | 1.00 | 0.00 | XXXX | 2495 |
| ATOM | 2496 | O | ILE A | 334 | −13.033 | 53.116 | 17.386 | 1.00 | 0.00 | XXXX | 2496 |
| ATOM | 2497 | CB | ILE A | 334 | −11.123 | 53.570 | 19.640 | 1.00 | 0.00 | XXXX | 2497 |
| ATOM | 2498 | CG1 | ILE A | 334 | −10.004 | 53.212 | 20.621 | 1.00 | 0.00 | XXXX | 2498 |
| ATOM | 2499 | CG2 | ILE A | 334 | −11.893 | 54.778 | 20.141 | 1.00 | 0.00 | XXXX | 2499 |
| ATOM | 2500 | CD1 | ILE A | 334 | −9.090 | 54.369 | 20.955 | 1.00 | 0.00 | XXXX | 2500 |
| ATOM | 2501 | N | ASP A | 335 | −14.438 | 52.692 | 19.095 | 1.00 | 0.00 | XXXX | 2501 |
| ATOM | 2502 | CA | ASP A | 335 | −15.640 | 53.089 | 18.372 | 1.00 | 0.00 | XXXX | 2502 |
| ATOM | 2503 | C | ASP A | 335 | −15.686 | 54.607 | 18.244 | 1.00 | 0.00 | XXXX | 2503 |
| ATOM | 2504 | O | ASP A | 335 | −15.881 | 55.310 | 19.233 | 1.00 | 0.00 | XXXX | 2504 |
| ATOM | 2505 | CB | ASP A | 335 | −16.893 | 52.568 | 19.085 | 1.00 | 0.00 | XXXX | 2505 |
| ATOM | 2506 | CG | ASP A | 335 | −18.163 | 52.767 | 18.273 | 1.00 | 0.00 | XXXX | 2506 |
| ATOM | 2507 | OD1 | ASP A | 335 | −18.156 | 53.565 | 17.311 | 1.00 | 0.00 | XXXX | 2507 |
| ATOM | 2508 | OD2 | ASP A | 335 | −19.179 | 52.118 | 18.599 | 1.00 | 0.00 | XXXX | 2508 |
| ATOM | 2509 | N | GLY A | 336 | −15.499 | 55.102 | 17.024 | 1.00 | 0.00 | XXXX | 2509 |
| ATOM | 2510 | CA | GLY A | 336 | −15.538 | 56.529 | 16.760 | 1.00 | 0.00 | XXXX | 2510 |
| ATOM | 2511 | C | GLY A | 336 | −16.835 | 57.200 | 17.172 | 1.00 | 0.00 | XXXX | 2511 |
| ATOM | 2512 | O | GLY A | 336 | −16.859 | 58.398 | 17.457 | 1.00 | 0.00 | XXXX | 2512 |
| ATOM | 2513 | N | ASP A | 337 | −17.916 | 56.428 | 17.208 | 1.00 | 0.00 | XXXX | 2513 |
| ATOM | 2514 | CA | ASP A | 337 | −19.229 | 56.959 | 17.564 | 1.00 | 0.00 | XXXX | 2514 |
| ATOM | 2515 | C | ASP A | 337 | −19.320 | 57.441 | 19.011 | 1.00 | 0.00 | XXXX | 2515 |
| ATOM | 2516 | O | ASP A | 337 | −20.075 | 58.365 | 19.313 | 1.00 | 0.00 | XXXX | 2516 |
| ATOM | 2517 | CB | ASP A | 337 | −20.312 | 55.906 | 17.313 | 1.00 | 0.00 | XXXX | 2517 |
| ATOM | 2518 | CG | ASP A | 337 | −20.620 | 55.723 | 15.841 | 1.00 | 0.00 | XXXX | 2518 |
| ATOM | 2519 | OD1 | ASP A | 337 | −20.189 | 56.572 | 15.033 | 1.00 | 0.00 | XXXX | 2519 |
| ATOM | 2520 | OD2 | ASP A | 337 | −21.295 | 54.734 | 15.492 | 1.00 | 0.00 | XXXX | 2520 |
| ATOM | 2521 | N | ASN A | 338 | −18.557 | 56.822 | 19.907 | 1.00 | 0.00 | XXXX | 2521 |
| ATOM | 2522 | CA | ASN A | 338 | −18.741 | 57.071 | 21.334 | 1.00 | 0.00 | XXXX | 2522 |
| ATOM | 2523 | C | ASN A | 338 | −17.491 | 56.873 | 22.188 | 1.00 | 0.00 | XXXX | 2523 |
| ATOM | 2524 | O | ASN A | 338 | −17.551 | 56.972 | 23.413 | 1.00 | 0.00 | XXXX | 2524 |
| ATOM | 2525 | CB | ASN A | 338 | −19.866 | 56.177 | 21.860 | 1.00 | 0.00 | XXXX | 2525 |
| ATOM | 2526 | CG | ASN A | 338 | −19.669 | 54.720 | 21.491 | 1.00 | 0.00 | XXXX | 2526 |
| ATOM | 2527 | OD1 | ASN A | 338 | −18.542 | 54.227 | 21.444 | 1.00 | 0.00 | XXXX | 2527 |
| ATOM | 2528 | ND2 | ASN A | 338 | −20.766 | 54.025 | 21.219 | 1.00 | 0.00 | XXXX | 2528 |
| ATOM | 2529 | N | GLN A | 339 | −16.364 | 56.594 | 21.540 | 1.00 | 0.00 | XXXX | 2529 |
| ATOM | 2530 | CA | GLN A | 339 | −15.084 | 56.460 | 22.234 | 1.00 | 0.00 | XXXX | 2530 |
| ATOM | 2531 | C | GLN A | 339 | −15.061 | 55.291 | 23.224 | 1.00 | 0.00 | XXXX | 2531 |
| ATOM | 2532 | O | GLN A | 339 | −14.222 | 55.246 | 24.125 | 1.00 | 0.00 | XXXX | 2532 |
| ATOM | 2533 | CB | GLN A | 339 | −14.733 | 57.772 | 22.943 | 1.00 | 0.00 | XXXX | 2533 |
| ATOM | 2534 | CG | GLN A | 339 | −14.724 | 58.970 | 22.001 | 1.00 | 0.00 | XXXX | 2534 |
| ATOM | 2535 | CD | GLN A | 339 | −14.136 | 60.221 | 22.622 | 1.00 | 0.00 | XXXX | 2535 |
| ATOM | 2536 | OE1 | GLN A | 339 | −13.869 | 61.202 | 21.927 | 1.00 | 0.00 | XXXX | 2536 |
| ATOM | 2537 | NE2 | GLN A | 339 | −13.934 | 60.198 | 23.934 | 1.00 | 0.00 | XXXX | 2537 |
| ATOM | 2538 | N | HIS A | 340 | −15.993 | 54.357 | 23.054 | 1.00 | 0.00 | XXXX | 2538 |
| ATOM | 2539 | CA | HIS A | 340 | −15.944 | 53.071 | 23.749 | 1.00 | 0.00 | XXXX | 2539 |
| ATOM | 2540 | C | HIS A | 340 | −15.174 | 52.053 | 22.905 | 1.00 | 0.00 | XXXX | 2540 |
| ATOM | 2541 | O | HIS A | 340 | −14.686 | 52.380 | 21.823 | 1.00 | 0.00 | XXXX | 2541 |
| ATOM | 2542 | CB | HIS A | 340 | −17.355 | 52.554 | 24.049 | 1.00 | 0.00 | XXXX | 2542 |
| ATOM | 2543 | CG | HIS A | 340 | −18.081 | 53.333 | 25.103 | 1.00 | 0.00 | XXXX | 2543 |
| ATOM | 2544 | ND1 | HIS A | 340 | −18.343 | 54.682 | 24.988 | 1.00 | 0.00 | XXXX | 2544 |
| ATOM | 2545 | CD2 | HIS A | 340 | −18.612 | 52.947 | 26.287 | 1.00 | 0.00 | XXXX | 2545 |
| ATOM | 2546 | CE1 | HIS A | 340 | −19.000 | 55.093 | 26.058 | 1.00 | 0.00 | XXXX | 2546 |
| ATOM | 2547 | NE2 | HIS A | 340 | −19.175 | 54.060 | 26.862 | 1.00 | 0.00 | XXXX | 2547 |
| ATOM | 2548 | O | LEU A | 341 | −16.282 | 48.308 | 22.766 | 1.00 | 0.00 | XXXX | 2548 |
| ATOM | 2549 | N | LEU A | 341 | −15.066 | 50.822 | 23.399 | 1.00 | 0.00 | XXXX | 2549 |
| ATOM | 2550 | CA | LEU A | 341 | −14.371 | 49.759 | 22.670 | 1.00 | 0.00 | XXXX | 2550 |
| ATOM | 2551 | C | LEU A | 341 | −15.301 | 48.682 | 22.123 | 1.00 | 0.00 | XXXX | 2551 |
| ATOM | 2552 | CB | LEU A | 341 | −13.332 | 49.077 | 23.567 | 1.00 | 0.00 | XXXX | 2552 |
| ATOM | 2553 | CG | LEU A | 341 | −11.973 | 49.718 | 23.842 | 1.00 | 0.00 | XXXX | 2553 |
| ATOM | 2554 | CD1 | LEU A | 341 | −11.146 | 48.789 | 24.722 | 1.00 | 0.00 | XXXX | 2554 |
| ATOM | 2555 | CD2 | LEU A | 341 | −11.239 | 50.014 | 22.544 | 1.00 | 0.00 | XXXX | 2555 |
| ATOM | 2556 | N | TYR A | 342 | −14.982 | 48.187 | 20.930 | 1.00 | 0.00 | XXXX | 2556 |
| ATOM | 2557 | CA | TYR A | 342 | −15.501 | 46.900 | 20.484 | 1.00 | 0.00 | XXXX | 2557 |
| ATOM | 2558 | C | TYR A | 342 | −14.879 | 45.808 | 21.343 | 1.00 | 0.00 | XXXX | 2558 |
| ATOM | 2559 | O | TYR A | 342 | −13.655 | 45.681 | 21.398 | 1.00 | 0.00 | XXXX | 2559 |
| ATOM | 2560 | CB | TYR A | 342 | −15.185 | 46.646 | 19.008 | 1.00 | 0.00 | XXXX | 2560 |
| ATOM | 2561 | CG | TYR A | 342 | −16.077 | 47.366 | 18.022 | 1.00 | 0.00 | XXXX | 2561 |
| ATOM | 2562 | CD1 | TYR A | 342 | −16.048 | 48.749 | 17.902 | 1.00 | 0.00 | XXXX | 2562 |
| ATOM | 2563 | CD2 | TYR A | 342 | −16.933 | 46.654 | 17.192 | 1.00 | 0.00 | XXXX | 2563 |
| ATOM | 2564 | CE1 | TYR A | 342 | −16.861 | 49.402 | 16.990 | 1.00 | 0.00 | XXXX | 2564 |
| ATOM | 2565 | CE2 | TYR A | 342 | −17.745 | 47.296 | 16.280 | 1.00 | 0.00 | XXXX | 2565 |
| ATOM | 2566 | CZ | TYR A | 342 | −17.706 | 48.670 | 16.183 | 1.00 | 0.00 | XXXX | 2566 |
| ATOM | 2567 | OH | TYR A | 342 | −18.515 | 49.309 | 15.273 | 1.00 | 0.00 | XXXX | 2567 |
| ATOM | 2568 | N | LYS A | 343 | −15.713 | 45.019 | 22.013 | 1.00 | 0.00 | XXXX | 2568 |
| ATOM | 2569 | CA | LYS A | 343 | −15.204 | 43.957 | 22.872 | 1.00 | 0.00 | XXXX | 2569 |
| ATOM | 2570 | C | LYS A | 343 | −16.005 | 42.666 | 22.735 | 1.00 | 0.00 | XXXX | 2570 |

-continued

| | | | | | | | | | | |
|---|---|---|---|---|---|---|---|---|---|---|
| ATOM | 2571 | O | LYS A | 343 | −17.205 | 42.688 | 22.462 | 1.00 | 0.00 | XXXX | 2571 |
| ATOM | 2572 | CB | LYS A | 343 | −15.198 | 44.409 | 24.335 | 1.00 | 0.00 | XXXX | 2572 |
| ATOM | 2573 | CG | LYS A | 343 | −14.585 | 45.784 | 24.559 | 1.00 | 0.00 | XXXX | 2573 |
| ATOM | 2574 | CD | LYS A | 343 | −14.347 | 46.051 | 26.036 | 1.00 | 0.00 | XXXX | 2574 |
| ATOM | 2575 | CE | LYS A | 343 | −13.164 | 45.247 | 26.554 | 1.00 | 0.00 | XXXX | 2575 |
| ATOM | 2576 | NZ | LYS A | 343 | −12.938 | 45.466 | 28.008 | 1.00 | 0.00 | XXXX | 2576 |
| ATOM | 2577 | N | THR A | 344 | −15.323 | 41.542 | 22.922 | 1.00 | 0.00 | XXXX | 2577 |
| ATOM | 2578 | CA | THR A | 344 | −15.974 | 40.240 | 22.954 | 1.00 | 0.00 | XXXX | 2578 |
| ATOM | 2579 | C | THR A | 344 | −16.641 | 40.031 | 24.309 | 1.00 | 0.00 | XXXX | 2579 |
| ATOM | 2580 | O | THR A | 344 | −16.114 | 40.457 | 25.334 | 1.00 | 0.00 | XXXX | 2580 |
| ATOM | 2581 | CB | THR A | 344 | −14.972 | 39.101 | 22.694 | 1.00 | 0.00 | XXXX | 2581 |
| ATOM | 2582 | OG1 | THR A | 344 | −14.387 | 39.263 | 21.395 | 1.00 | 0.00 | XXXX | 2582 |
| ATOM | 2583 | CG2 | THR A | 344 | −15.666 | 37.750 | 22.774 | 1.00 | 0.00 | XXXX | 2583 |
| ATOM | 2584 | N | VAL A | 345 | −17.799 | 39.381 | 24.315 | 1.00 | 0.00 | XXXX | 2584 |
| ATOM | 2585 | CA | VAL A | 345 | −18.483 | 39.078 | 25.567 | 1.00 | 0.00 | XXXX | 2585 |
| ATOM | 2586 | C | VAL A | 345 | −18.241 | 37.630 | 25.970 | 1.00 | 0.00 | XXXX | 2586 |
| ATOM | 2587 | O | VAL A | 345 | −18.361 | 36.727 | 25.145 | 1.00 | 0.00 | XXXX | 2587 |
| ATOM | 2588 | CB | VAL A | 345 | −19.994 | 39.328 | 25.460 | 1.00 | 0.00 | XXXX | 2588 |
| ATOM | 2589 | CG1 | VAL A | 345 | −20.672 | 39.036 | 26.789 | 1.00 | 0.00 | XXXX | 2589 |
| ATOM | 2590 | CG2 | VAL A | 345 | −20.261 | 40.757 | 25.013 | 1.00 | 0.00 | XXXX | 2590 |
| ATOM | 2591 | N | ARG A | 346 | −17.902 | 37.413 | 27.239 | 1.00 | 0.00 | XXXX | 2591 |
| ATOM | 2592 | CA | ARG A | 346 | −17.636 | 36.066 | 27.731 | 1.00 | 0.00 | XXXX | 2592 |
| ATOM | 2593 | C | ARG A | 346 | −18.294 | 35.850 | 29.091 | 1.00 | 0.00 | XXXX | 2593 |
| ATOM | 2594 | O | ARG A | 346 | −18.254 | 36.727 | 29.956 | 1.00 | 0.00 | XXXX | 2594 |
| ATOM | 2595 | CB | ARG A | 346 | −16.130 | 35.822 | 27.856 | 1.00 | 0.00 | XXXX | 2595 |
| ATOM | 2596 | CG | ARG A | 346 | −15.292 | 36.437 | 26.746 | 1.00 | 0.00 | XXXX | 2596 |
| ATOM | 2597 | CD | ARG A | 346 | −13.810 | 36.130 | 26.937 | 1.00 | 0.00 | XXXX | 2597 |
| ATOM | 2598 | NE | ARG A | 346 | −12.994 | 36.556 | 25.798 | 1.00 | 0.00 | XXXX | 2598 |
| ATOM | 2599 | CZ | ARG A | 346 | −12.634 | 35.788 | 24.777 | 1.00 | 0.00 | XXXX | 2599 |
| ATOM | 2600 | NH1 | ARG A | 346 | −13.016 | 34.521 | 24.720 | 1.00 | 0.00 | XXXX | 2600 |
| ATOM | 2601 | NH2 | ARG A | 346 | −11.886 | 36.297 | 23.806 | 1.00 | 0.00 | XXXX | 2601 |
| ATOM | 2602 | N | ILE A | 347 | −18.892 | 34.679 | 29.275 | 1.00 | 0.00 | XXXX | 2602 |
| ATOM | 2603 | CA | ILE A | 347 | −19.439 | 34.291 | 30.568 | 1.00 | 0.00 | XXXX | 2603 |
| ATOM | 2604 | C | ILE A | 347 | −18.739 | 33.023 | 31.048 | 1.00 | 0.00 | XXXX | 2604 |
| ATOM | 2605 | O | ILE A | 347 | −18.508 | 32.102 | 30.265 | 1.00 | 0.00 | XXXX | 2605 |
| ATOM | 2606 | CB | ILE A | 347 | −20.959 | 34.062 | 30.500 | 1.00 | 0.00 | XXXX | 2606 |
| ATOM | 2607 | CG1 | ILE A | 347 | −21.673 | 35.358 | 30.105 | 1.00 | 0.00 | XXXX | 2607 |
| ATOM | 2608 | CG2 | ILE A | 347 | −21.479 | 33.541 | 31.830 | 1.00 | 0.00 | XXXX | 2608 |
| ATOM | 2609 | CD1 | ILE A | 347 | −23.171 | 35.207 | 29.928 | 1.00 | 0.00 | XXXX | 2609 |
| ATOM | 2610 | N | GLY A | 348 | −18.392 | 32.979 | 32.329 | 1.00 | 0.00 | XXXX | 2610 |
| ATOM | 2611 | CA | GLY A | 348 | −17.651 | 31.850 | 32.861 | 1.00 | 0.00 | XXXX | 2611 |
| ATOM | 2612 | C | GLY A | 348 | −17.961 | 31.520 | 34.306 | 1.00 | 0.00 | XXXX | 2612 |
| ATOM | 2613 | O | GLY A | 348 | −18.590 | 32.306 | 35.016 | 1.00 | 0.00 | XXXX | 2613 |
| ATOM | 2614 | N | GLU A | 349 | −17.516 | 30.346 | 34.743 | 1.00 | 0.00 | XXXX | 2614 |
| ATOM | 2615 | CA | GLU A | 349 | −17.659 | 29.951 | 36.138 | 1.00 | 0.00 | XXXX | 2615 |
| ATOM | 2616 | C | GLU A | 349 | −16.298 | 29.905 | 36.823 | 1.00 | 0.00 | XXXX | 2616 |
| ATOM | 2617 | O | GLU A | 349 | −15.285 | 29.580 | 36.202 | 1.00 | 0.00 | XXXX | 2617 |
| ATOM | 2618 | CB | GLU A | 349 | −18.355 | 28.593 | 36.255 | 1.00 | 0.00 | XXXX | 2618 |
| ATOM | 2619 | CG | GLU A | 349 | −17.580 | 27.430 | 35.659 | 1.00 | 0.00 | XXXX | 2619 |
| ATOM | 2620 | CD | GLU A | 349 | −18.232 | 26.090 | 35.950 | 1.00 | 0.00 | XXXX | 2620 |
| ATOM | 2621 | OE1 | GLU A | 349 | −18.860 | 25.954 | 37.022 | 1.00 | 0.00 | XXXX | 2621 |
| ATOM | 2622 | OE2 | GLU A | 349 | −18.115 | 25.174 | 35.109 | 1.00 | 0.00 | XXXX | 2622 |
| ATOM | 2623 | N | ILE A | 350 | −16.285 | 30.239 | 38.107 | 1.00 | 0.00 | XXXX | 2623 |
| ATOM | 2624 | CA | ILE A | 350 | −15.045 | 30.306 | 38.867 | 1.00 | 0.00 | XXXX | 2624 |
| ATOM | 2625 | C | ILE A | 350 | −14.586 | 28.917 | 39.295 | 1.00 | 0.00 | XXXX | 2625 |
| ATOM | 2626 | O | ILE A | 350 | −15.362 | 28.140 | 39.853 | 1.00 | 0.00 | XXXX | 2626 |
| ATOM | 2627 | CB | ILE A | 350 | −15.207 | 31.203 | 40.106 | 1.00 | 0.00 | XXXX | 2627 |
| ATOM | 2628 | CG1 | ILE A | 350 | −15.692 | 32.593 | 39.687 | 1.00 | 0.00 | XXXX | 2628 |
| ATOM | 2629 | CG2 | ILE A | 350 | −13.899 | 31.287 | 40.878 | 1.00 | 0.00 | XXXX | 2629 |
| ATOM | 2630 | CD1 | ILE A | 350 | −16.161 | 33.459 | 40.836 | 1.00 | 0.00 | XXXX | 2630 |
| ATOM | 2631 | N | LEU A | 351 | −13.320 | 28.611 | 39.028 | 1.00 | 0.00 | XXXX | 2631 |
| ATOM | 2632 | CA | LEU A | 351 | −12.757 | 27.304 | 39.350 | 1.00 | 0.00 | XXXX | 2632 |
| ATOM | 2633 | C | LEU A | 351 | −12.110 | 27.296 | 40.732 | 1.00 | 0.00 | XXXX | 2633 |
| ATOM | 2634 | O | LEU A | 351 | −11.952 | 28.341 | 41.362 | 1.00 | 0.00 | XXXX | 2634 |
| ATOM | 2635 | CB | LEU A | 351 | −11.734 | 26.884 | 38.292 | 1.00 | 0.00 | XXXX | 2635 |
| ATOM | 2636 | CG | LEU A | 351 | −12.255 | 26.738 | 36.860 | 1.00 | 0.00 | XXXX | 2636 |
| ATOM | 2637 | CD1 | LEU A | 351 | −11.108 | 26.464 | 35.896 | 1.00 | 0.00 | XXXX | 2637 |
| ATOM | 2638 | CD2 | LEU A | 351 | −13.306 | 25.640 | 36.777 | 1.00 | 0.00 | XXXX | 2638 |
| ATOM | 2639 | N | GLU A | 352 | −11.746 | 26.104 | 41.192 | 1.00 | 0.00 | XXXX | 2639 |
| ATOM | 2640 | CA | GLU A | 352 | −11.170 | 25.918 | 42.519 | 1.00 | 0.00 | XXXX | 2640 |
| ATOM | 2641 | C | GLU A | 352 | −9.900 | 26.746 | 42.725 | 1.00 | 0.00 | XXXX | 2641 |
| ATOM | 2642 | O | GLU A | 352 | −9.612 | 27.183 | 43.839 | 1.00 | 0.00 | XXXX | 2642 |
| ATOM | 2643 | CB | GLU A | 352 | −10.874 | 24.435 | 42.755 | 1.00 | 0.00 | XXXX | 2643 |
| ATOM | 2644 | CG | GLU A | 352 | −10.297 | 24.114 | 44.122 | 1.00 | 0.00 | XXXX | 2644 |
| ATOM | 2645 | CD | GLU A | 352 | −9.880 | 22.661 | 44.250 | 1.00 | 0.00 | XXXX | 2645 |
| ATOM | 2646 | OE1 | GLU A | 352 | −9.159 | 22.165 | 43.359 | 1.00 | 0.00 | XXXX | 2646 |
| ATOM | 2647 | OE2 | GLU A | 352 | −10.274 | 22.014 | 45.243 | 1.00 | 0.00 | XXXX | 2647 |
| ATOM | 2648 | N | ASN A | 353 | −9.146 | 26.965 | 41.652 | 1.00 | 0.00 | XXXX | 2648 |
| ATOM | 2649 | CA | ASN A | 353 | −7.907 | 27.731 | 41.743 | 1.00 | 0.00 | XXXX | 2649 |

| | | | | | | | | | | |
|---|---|---|---|---|---|---|---|---|---|---|
| ATOM | 2650 | C | ASN A | 353 | −8.110 | 29.227 | 41.501 | 1.00 | 0.00 | XXXX | 2650 |
| ATOM | 2651 | O | ASN A | 353 | −7.145 | 29.988 | 41.432 | 1.00 | 0.00 | XXXX | 2651 |
| ATOM | 2652 | CB | ASN A | 353 | −6.873 | 27.179 | 40.759 | 1.00 | 0.00 | XXXX | 2652 |
| ATOM | 2653 | CG | ASN A | 353 | −7.319 | 27.293 | 39.316 | 1.00 | 0.00 | XXXX | 2653 |
| ATOM | 2654 | OD1 | ASN A | 353 | −8.480 | 27.586 | 39.032 | 1.00 | 0.00 | XXXX | 2654 |
| ATOM | 2655 | ND2 | ASN A | 353 | −6.395 | 27.052 | 38.392 | 1.00 | 0.00 | XXXX | 2655 |
| ATOM | 2656 | N | GLY A | 354 | −9.366 | 29.644 | 41.375 | 1.00 | 0.00 | XXXX | 2656 |
| ATOM | 2657 | CA | GLY A | 354 | −9.685 | 31.048 | 41.181 | 1.00 | 0.00 | XXXX | 2657 |
| ATOM | 2658 | C | GLY A | 354 | −9.704 | 31.505 | 39.733 | 1.00 | 0.00 | XXXX | 2658 |
| ATOM | 2659 | O | GLY A | 354 | −10.056 | 32.649 | 39.444 | 1.00 | 0.00 | XXXX | 2659 |
| ATOM | 2660 | N | GLN A | 355 | −9.330 | 30.617 | 38.818 | 1.00 | 0.00 | XXXX | 2660 |
| ATOM | 2661 | CA | GLN A | 355 | −9.386 | 30.933 | 37.395 | 1.00 | 0.00 | XXXX | 2661 |
| ATOM | 2662 | C | GLN A | 355 | −10.797 | 30.743 | 36.850 | 1.00 | 0.00 | XXXX | 2662 |
| ATOM | 2663 | O | GLN A | 355 | −11.660 | 30.183 | 37.526 | 1.00 | 0.00 | XXXX | 2663 |
| ATOM | 2664 | CB | GLN A | 355 | −8.394 | 30.072 | 36.614 | 1.00 | 0.00 | XXXX | 2664 |
| ATOM | 2665 | CG | GLN A | 355 | −6.944 | 30.396 | 36.918 | 1.00 | 0.00 | XXXX | 2665 |
| ATOM | 2666 | CD | GLN A | 355 | −6.537 | 31.767 | 36.412 | 1.00 | 0.00 | XXXX | 2666 |
| ATOM | 2667 | OE1 | GLN A | 355 | −6.607 | 32.044 | 35.214 | 1.00 | 0.00 | XXXX | 2667 |
| ATOM | 2668 | NE2 | GLN A | 355 | −6.114 | 32.634 | 37.325 | 1.00 | 0.00 | XXXX | 2668 |
| ATOM | 2669 | N | ILE A | 356 | −11.025 | 31.206 | 35.625 | 1.00 | 0.00 | XXXX | 2669 |
| ATOM | 2670 | CA | ILE A | 356 | −12.357 | 31.157 | 35.035 | 1.00 | 0.00 | XXXX | 2670 |
| ATOM | 2671 | C | ILE A | 356 | −12.451 | 30.118 | 33.924 | 1.00 | 0.00 | XXXX | 2671 |
| ATOM | 2672 | O | ILE A | 356 | −11.575 | 30.025 | 33.063 | 1.00 | 0.00 | XXXX | 2672 |
| ATOM | 2673 | CB | ILE A | 356 | −12.772 | 32.527 | 34.458 | 1.00 | 0.00 | XXXX | 2673 |
| ATOM | 2674 | CG1 | ILE A | 356 | −12.537 | 33.640 | 35.481 | 1.00 | 0.00 | XXXX | 2674 |
| ATOM | 2675 | CG2 | ILE A | 356 | −14.227 | 32.495 | 33.998 | 1.00 | 0.00 | XXXX | 2675 |
| ATOM | 2676 | CD1 | ILE A | 356 | −13.311 | 33.465 | 36.769 | 1.00 | 0.00 | XXXX | 2676 |
| ATOM | 2677 | N | ARG A | 357 | −13.522 | 29.333 | 33.958 | 1.00 | 0.00 | XXXX | 2677 |
| ATOM | 2678 | CA | ARG A | 357 | −13.852 | 28.421 | 32.873 | 1.00 | 0.00 | XXXX | 2678 |
| ATOM | 2679 | C | ARG A | 357 | −14.952 | 29.028 | 32.014 | 1.00 | 0.00 | XXXX | 2679 |
| ATOM | 2680 | O | ARG A | 357 | −16.069 | 29.242 | 32.485 | 1.00 | 0.00 | XXXX | 2680 |
| ATOM | 2681 | CB | ARG A | 357 | −14.284 | 27.062 | 33.427 | 1.00 | 0.00 | XXXX | 2681 |
| ATOM | 2682 | CG | ARG A | 357 | −14.749 | 26.065 | 32.380 | 1.00 | 0.00 | XXXX | 2682 |
| ATOM | 2683 | CD | ARG A | 357 | −15.100 | 24.741 | 33.038 | 1.00 | 0.00 | XXXX | 2683 |
| ATOM | 2684 | NE | ARG A | 357 | −15.602 | 23.748 | 32.093 | 1.00 | 0.00 | XXXX | 2684 |
| ATOM | 2685 | CZ | ARG A | 357 | −16.888 | 23.458 | 31.926 | 1.00 | 0.00 | XXXX | 2685 |
| ATOM | 2686 | NH1 | ARG A | 357 | −17.810 | 24.086 | 32.642 | 1.00 | 0.00 | XXXX | 2686 |
| ATOM | 2687 | NH2 | ARG A | 357 | −17.253 | 22.537 | 31.044 | 1.00 | 0.00 | XXXX | 2687 |
| ATOM | 2688 | N | GLU A | 358 | −14.634 | 29.312 | 30.755 | 1.00 | 0.00 | XXXX | 2688 |
| ATOM | 2689 | CA | GLU A | 358 | −15.595 | 29.955 | 29.869 | 1.00 | 0.00 | XXXX | 2689 |
| ATOM | 2690 | C | GLU A | 358 | −16.735 | 29.006 | 29.520 | 1.00 | 0.00 | XXXX | 2690 |
| ATOM | 2691 | O | GLU A | 358 | −16.506 | 27.869 | 29.113 | 1.00 | 0.00 | XXXX | 2691 |
| ATOM | 2692 | CB | GLU A | 358 | −14.911 | 30.449 | 28.593 | 1.00 | 0.00 | XXXX | 2692 |
| ATOM | 2693 | CG | GLU A | 358 | −15.858 | 31.107 | 27.604 | 1.00 | 0.00 | XXXX | 2693 |
| ATOM | 2694 | CD | GLU A | 358 | −15.139 | 31.679 | 26.397 | 1.00 | 0.00 | XXXX | 2694 |
| ATOM | 2695 | OE1 | GLU A | 358 | −14.455 | 32.713 | 26.545 | 1.00 | 0.00 | XXXX | 2695 |
| ATOM | 2696 | OE2 | GLU A | 358 | −15.259 | 31.094 | 25.301 | 1.00 | 0.00 | XXXX | 2696 |
| ATOM | 2697 | N | LEU A | 359 | −17.963 | 29.485 | 29.687 | 1.00 | 0.00 | XXXX | 2697 |
| ATOM | 2698 | CA | LEU A | 359 | −19.148 | 28.694 | 29.386 | 1.00 | 0.00 | XXXX | 2698 |
| ATOM | 2699 | C | LEU A | 359 | −19.801 | 29.158 | 28.088 | 1.00 | 0.00 | XXXX | 2699 |
| ATOM | 2700 | O | LEU A | 359 | −20.470 | 28.385 | 27.405 | 1.00 | 0.00 | XXXX | 2700 |
| ATOM | 2701 | CB | LEU A | 359 | −20.156 | 28.782 | 30.534 | 1.00 | 0.00 | XXXX | 2701 |
| ATOM | 2702 | CG | LEU A | 359 | −19.674 | 28.375 | 31.927 | 1.00 | 0.00 | XXXX | 2702 |
| ATOM | 2703 | CD1 | LEU A | 359 | −20.766 | 28.615 | 32.958 | 1.00 | 0.00 | XXXX | 2703 |
| ATOM | 2704 | CD2 | LEU A | 359 | −19.233 | 26.919 | 31.938 | 1.00 | 0.00 | XXXX | 2704 |
| ATOM | 2705 | N | TRP A | 360 | −19.603 | 30.430 | 27.757 | 1.00 | 0.00 | XXXX | 2705 |
| ATOM | 2706 | CA | TRP A | 360 | −20.282 | 31.041 | 26.621 | 1.00 | 0.00 | XXXX | 2706 |
| ATOM | 2707 | C | TRP A | 360 | −19.572 | 32.316 | 26.177 | 1.00 | 0.00 | XXXX | 2707 |
| ATOM | 2708 | O | TRP A | 360 | −18.970 | 33.013 | 26.991 | 1.00 | 0.00 | XXXX | 2708 |
| ATOM | 2709 | CB | TRP A | 360 | −21.741 | 31.342 | 26.984 | 1.00 | 0.00 | XXXX | 2709 |
| ATOM | 2710 | CG | TRP A | 360 | −22.518 | 32.027 | 25.903 | 1.00 | 0.00 | XXXX | 2710 |
| ATOM | 2711 | CD1 | TRP A | 360 | −23.293 | 31.436 | 24.948 | 1.00 | 0.00 | XXXX | 2711 |
| ATOM | 2712 | CD2 | TRP A | 360 | −22.603 | 33.439 | 25.671 | 1.00 | 0.00 | XXXX | 2712 |
| ATOM | 2713 | NE1 | TRP A | 360 | −23.851 | 32.392 | 24.133 | 1.00 | 0.00 | XXXX | 2713 |
| ATOM | 2714 | CE2 | TRP A | 360 | −23.442 | 33.629 | 24.556 | 1.00 | 0.00 | XXXX | 2714 |
| ATOM | 2715 | CE3 | TRP A | 360 | −22.046 | 34.560 | 26.296 | 1.00 | 0.00 | XXXX | 2715 |
| ATOM | 2716 | CZ2 | TRP A | 360 | −23.740 | 34.894 | 24.052 | 1.00 | 0.00 | XXXX | 2716 |
| ATOM | 2717 | CZ3 | TRP A | 360 | −22.343 | 35.816 | 25.794 | 1.00 | 0.00 | XXXX | 2717 |
| ATOM | 2718 | CH2 | TRP A | 360 | −23.183 | 35.972 | 24.684 | 1.00 | 0.00 | XXXX | 2718 |
| ATOM | 2719 | N | LYS A | 361 | −19.644 | 32.618 | 24.885 | 1.00 | 0.00 | XXXX | 2719 |
| ATOM | 2720 | CA | LYS A | 361 | −19.105 | 33.872 | 24.368 | 1.00 | 0.00 | XXXX | 2720 |
| ATOM | 2721 | C | LYS A | 361 | −19.741 | 34.246 | 23.037 | 1.00 | 0.00 | XXXX | 2721 |
| ATOM | 2722 | O | LYS A | 361 | −20.352 | 33.409 | 22.372 | 1.00 | 0.00 | XXXX | 2722 |
| ATOM | 2723 | CB | LYS A | 361 | −17.585 | 33.788 | 24.203 | 1.00 | 0.00 | XXXX | 2723 |
| ATOM | 2724 | CG | LYS A | 361 | −17.132 | 32.927 | 23.031 | 1.00 | 0.00 | XXXX | 2724 |
| ATOM | 2725 | CD | LYS A | 361 | −15.651 | 33.116 | 22.750 | 1.00 | 0.00 | XXXX | 2725 |
| ATOM | 2726 | CE | LYS A | 361 | −15.155 | 32.152 | 21.684 | 1.00 | 0.00 | XXXX | 2726 |
| ATOM | 2727 | NZ | LYS A | 361 | −13.716 | 32.388 | 21.369 | 1.00 | 0.00 | XXXX | 2727 |
| ATOM | 2728 | N | THR A | 362 | −19.594 | 35.510 | 22.655 | 1.00 | 0.00 | XXXX | 2728 |

-continued

| | | | | | | | | | | |
|---|---|---|---|---|---|---|---|---|---|---|
| ATOM | 2729 | CA | THR A | 362 | −19.992 | 35.948 | 21.325 | 1.00 | 0.00 | XXXX | 2729 |
| ATOM | 2730 | C | THR A | 362 | −18.936 | 35.510 | 20.315 | 1.00 | 0.00 | XXXX | 2730 |
| ATOM | 2731 | O | THR A | 362 | −17.761 | 35.385 | 20.655 | 1.00 | 0.00 | XXXX | 2731 |
| ATOM | 2732 | CB | THR A | 362 | −20.183 | 37.475 | 21.256 | 1.00 | 0.00 | XXXX | 2732 |
| ATOM | 2733 | OG1 | THR A | 362 | −18.989 | 38.128 | 21.704 | 1.00 | 0.00 | XXXX | 2733 |
| ATOM | 2734 | CG2 | THR A | 362 | −21.349 | 37.909 | 22.132 | 1.00 | 0.00 | XXXX | 2734 |
| ATOM | 2735 | N | ASN A | 363 | −19.353 | 35.285 | 19.073 | 1.00 | 0.00 | XXXX | 2735 |
| ATOM | 2736 | CA | ASN A | 363 | −18.437 | 34.799 | 18.048 | 1.00 | 0.00 | XXXX | 2736 |
| ATOM | 2737 | C | ASN A | 363 | −17.560 | 35.912 | 17.488 | 1.00 | 0.00 | XXXX | 2737 |
| ATOM | 2738 | O | ASN A | 363 | −16.540 | 35.653 | 16.846 | 1.00 | 0.00 | XXXX | 2738 |
| ATOM | 2739 | CB | ASN A | 363 | −19.215 | 34.129 | 16.916 | 1.00 | 0.00 | XXXX | 2739 |
| ATOM | 2740 | CG | ASN A | 363 | −19.865 | 32.831 | 17.348 | 1.00 | 0.00 | XXXX | 2740 |
| ATOM | 2741 | OD1 | ASN A | 363 | −21.079 | 32.662 | 17.231 | 1.00 | 0.00 | XXXX | 2741 |
| ATOM | 2742 | ND2 | ASN A | 363 | −19.060 | 31.905 | 17.858 | 1.00 | 0.00 | XXXX | 2742 |
| ATOM | 2743 | N | LYS A | 364 | −17.961 | 37.153 | 17.742 | 1.00 | 0.00 | XXXX | 2743 |
| ATOM | 2744 | CA | LYS A | 364 | −17.186 | 38.316 | 17.329 | 1.00 | 0.00 | XXXX | 2744 |
| ATOM | 2745 | C | LYS A | 364 | −17.270 | 39.407 | 18.388 | 1.00 | 0.00 | XXXX | 2745 |
| ATOM | 2746 | O | LYS A | 364 | −18.127 | 39.353 | 19.270 | 1.00 | 0.00 | XXXX | 2746 |
| ATOM | 2747 | CB | LYS A | 364 | −17.682 | 38.845 | 15.983 | 1.00 | 0.00 | XXXX | 2747 |
| ATOM | 2748 | CG | LYS A | 364 | −17.562 | 37.846 | 14.845 | 1.00 | 0.00 | XXXX | 2748 |
| ATOM | 2749 | CD | LYS A | 364 | −18.157 | 38.399 | 13.562 | 1.00 | 0.00 | XXXX | 2749 |
| ATOM | 2750 | CE | LYS A | 364 | −18.057 | 37.393 | 12.427 | 1.00 | 0.00 | XXXX | 2750 |
| ATOM | 2751 | NZ | LYS A | 364 | −18.680 | 37.909 | 11.176 | 1.00 | 0.00 | XXXX | 2751 |
| ATOM | 2752 | N | PRO A | 365 | −16.374 | 40.400 | 18.310 | 1.00 | 0.00 | XXXX | 2752 |
| ATOM | 2753 | CA | PRO A | 365 | −16.495 | 41.568 | 19.187 | 1.00 | 0.00 | XXXX | 2753 |
| ATOM | 2754 | C | PRO A | 365 | −17.820 | 42.290 | 18.967 | 1.00 | 0.00 | XXXX | 2754 |
| ATOM | 2755 | O | PRO A | 365 | −18.323 | 42.319 | 17.844 | 1.00 | 0.00 | XXXX | 2755 |
| ATOM | 2756 | CB | PRO A | 365 | −15.314 | 42.447 | 18.767 | 1.00 | 0.00 | XXXX | 2756 |
| ATOM | 2757 | CG | PRO A | 365 | −14.326 | 41.493 | 18.179 | 1.00 | 0.00 | XXXX | 2757 |
| ATOM | 2758 | CD | PRO A | 365 | −15.148 | 40.439 | 17.496 | 1.00 | 0.00 | XXXX | 2758 |
| ATOM | 2759 | N | VAL A | 366 | −18.373 | 42.865 | 20.029 | 1.00 | 0.00 | XXXX | 2759 |
| ATOM | 2760 | CA | VAL A | 366 | −19.647 | 43.569 | 19.947 | 1.00 | 0.00 | XXXX | 2760 |
| ATOM | 2761 | C | VAL A | 366 | −19.437 | 45.079 | 19.964 | 1.00 | 0.00 | XXXX | 2761 |
| ATOM | 2762 | O | VAL A | 366 | −18.663 | 45.594 | 20.771 | 1.00 | 0.00 | XXXX | 2762 |
| ATOM | 2763 | CB | VAL A | 366 | −20.581 | 43.171 | 21.103 | 1.00 | 0.00 | XXXX | 2763 |
| ATOM | 2764 | CG1 | VAL A | 366 | −21.907 | 43.912 | 20.996 | 1.00 | 0.00 | XXXX | 2764 |
| ATOM | 2765 | CG2 | VAL A | 366 | −20.802 | 41.665 | 21.107 | 1.00 | 0.00 | XXXX | 2765 |
| ATOM | 2766 | N | LYS A | 367 | −20.121 | 45.785 | 19.068 | 1.00 | 0.00 | XXXX | 2766 |
| ATOM | 2767 | CA | LYS A | 367 | −20.066 | 47.242 | 19.053 | 1.00 | 0.00 | XXXX | 2767 |
| ATOM | 2768 | C | LYS A | 367 | −20.631 | 47.801 | 20.352 | 1.00 | 0.00 | XXXX | 2768 |
| ATOM | 2769 | O | LYS A | 367 | −21.714 | 47.405 | 20.778 | 1.00 | 0.00 | XXXX | 2769 |
| ATOM | 2770 | CB | LYS A | 367 | −20.834 | 47.805 | 17.854 | 1.00 | 0.00 | XXXX | 2770 |
| ATOM | 2771 | CG | LYS A | 367 | −20.685 | 49.309 | 17.672 | 1.00 | 0.00 | XXXX | 2771 |
| ATOM | 2772 | CD | LYS A | 367 | −21.463 | 49.803 | 16.461 | 1.00 | 0.00 | XXXX | 2772 |
| ATOM | 2773 | CE | LYS A | 367 | −21.107 | 51.244 | 16.120 | 1.00 | 0.00 | XXXX | 2773 |
| ATOM | 2774 | NZ | LYS A | 367 | −21.412 | 52.182 | 17.235 | 1.00 | 0.00 | XXXX | 2774 |
| ATOM | 2775 | N | PRO A | 368 | −19.893 | 48.724 | 20.988 | 1.00 | 0.00 | XXXX | 2775 |
| ATOM | 2776 | CA | PRO A | 368 | −20.341 | 49.339 | 22.242 | 1.00 | 0.00 | XXXX | 2776 |
| ATOM | 2777 | C | PRO A | 368 | −21.603 | 50.172 | 22.049 | 1.00 | 0.00 | XXXX | 2777 |
| ATOM | 2778 | O | PRO A | 368 | −21.702 | 50.935 | 21.086 | 1.00 | 0.00 | XXXX | 2778 |
| ATOM | 2779 | CB | PRO A | 368 | −19.155 | 50.220 | 22.648 | 1.00 | 0.00 | XXXX | 2779 |
| ATOM | 2780 | CG | PRO A | 368 | −18.436 | 50.497 | 21.371 | 1.00 | 0.00 | XXXX | 2780 |
| ATOM | 2781 | CD | PRO A | 368 | −18.589 | 49.250 | 20.550 | 1.00 | 0.00 | XXXX | 2781 |
| ATOM | 2782 | N | ASP A | 369 | −22.552 | 50.022 | 22.967 | 1.00 | 0.00 | XXXX | 2782 |
| ATOM | 2783 | CA | ASP A | 369 | −23.852 | 50.674 | 22.862 | 1.00 | 0.00 | XXXX | 2783 |
| ATOM | 2784 | C | ASP A | 369 | −24.293 | 51.182 | 24.233 | 1.00 | 0.00 | XXXX | 2784 |
| ATOM | 2785 | O | ASP A | 369 | −25.224 | 50.645 | 24.830 | 1.00 | 0.00 | XXXX | 2785 |
| ATOM | 2786 | CB | ASP A | 369 | −24.883 | 49.698 | 22.286 | 1.00 | 0.00 | XXXX | 2786 |
| ATOM | 2787 | CG | ASP A | 369 | −26.217 | 50.356 | 21.987 | 1.00 | 0.00 | XXXX | 2787 |
| ATOM | 2788 | OD1 | ASP A | 369 | −26.309 | 51.600 | 22.057 | 1.00 | 0.00 | XXXX | 2788 |
| ATOM | 2789 | OD2 | ASP A | 369 | −27.178 | 49.619 | 21.677 | 1.00 | 0.00 | XXXX | 2789 |
| ATOM | 2790 | N | PRO A | 370 | −23.619 | 52.228 | 24.734 | 1.00 | 0.00 | XXXX | 2790 |
| ATOM | 2791 | CA | PRO A | 370 | −23.806 | 52.728 | 26.103 | 1.00 | 0.00 | XXXX | 2791 |
| ATOM | 2792 | C | PRO A | 370 | −25.222 | 53.223 | 26.402 | 1.00 | 0.00 | XXXX | 2792 |
| ATOM | 2793 | O | PRO A | 370 | −25.658 | 53.142 | 27.550 | 1.00 | 0.00 | XXXX | 2793 |
| ATOM | 2794 | CB | PRO A | 370 | −22.805 | 53.886 | 26.192 | 1.00 | 0.00 | XXXX | 2794 |
| ATOM | 2795 | CG | PRO A | 370 | −22.534 | 54.274 | 24.775 | 1.00 | 0.00 | XXXX | 2795 |
| ATOM | 2796 | CD | PRO A | 370 | −22.602 | 52.999 | 24.001 | 1.00 | 0.00 | XXXX | 2796 |
| ATOM | 2797 | N | TYR A | 371 | −25.930 | 53.722 | 25.394 | 1.00 | 0.00 | XXXX | 2797 |
| ATOM | 2798 | CA | TYR A | 371 | −27.285 | 54.218 | 25.614 | 1.00 | 0.00 | XXXX | 2798 |
| ATOM | 2799 | C | TYR A | 371 | −28.332 | 53.179 | 25.227 | 1.00 | 0.00 | XXXX | 2799 |
| ATOM | 2800 | O | TYR A | 371 | −29.529 | 53.466 | 25.218 | 1.00 | 0.00 | XXXX | 2800 |
| ATOM | 2801 | CB | TYR A | 371 | −27.514 | 55.520 | 24.846 | 1.00 | 0.00 | XXXX | 2801 |
| ATOM | 2802 | CG | TYR A | 371 | −26.791 | 56.702 | 25.452 | 1.00 | 0.00 | XXXX | 2802 |
| ATOM | 2803 | CD1 | TYR A | 371 | −27.344 | 57.411 | 26.512 | 1.00 | 0.00 | XXXX | 2803 |
| ATOM | 2804 | CD2 | TYR A | 371 | −25.555 | 57.109 | 24.968 | 1.00 | 0.00 | XXXX | 2804 |
| ATOM | 2805 | CE1 | TYR A | 371 | −26.684 | 58.490 | 27.074 | 1.00 | 0.00 | XXXX | 2805 |
| ATOM | 2806 | CE2 | TYR A | 371 | −24.889 | 58.187 | 25.522 | 1.00 | 0.00 | XXXX | 2806 |
| ATOM | 2807 | CZ | TYR A | 371 | −25.457 | 58.873 | 26.573 | 1.00 | 0.00 | XXXX | 2807 |

-continued

| ATOM | 2808 | OH  | TYR A | 371 | −24.796 | 59.946 | 27.125 | 1.00 | 0.00 | XXXX | 2808 |
| ATOM | 2809 | N   | LEU A | 372 | −27.867 | 51.973 | 24.913 | 1.00 | 0.00 | XXXX | 2809 |
| ATOM | 2810 | CA  | LEU A | 372 | −28.747 | 50.849 | 24.614 | 1.00 | 0.00 | XXXX | 2810 |
| ATOM | 2811 | C   | LEU A | 372 | −29.739 | 51.177 | 23.500 | 1.00 | 0.00 | XXXX | 2811 |
| ATOM | 2812 | O   | LEU A | 372 | −30.919 | 50.839 | 23.588 | 1.00 | 0.00 | XXXX | 2812 |
| ATOM | 2813 | CB  | LEU A | 372 | −29.497 | 50.421 | 25.877 | 1.00 | 0.00 | XXXX | 2813 |
| ATOM | 2814 | CG  | LEU A | 372 | −28.618 | 49.915 | 27.023 | 1.00 | 0.00 | XXXX | 2814 |
| ATOM | 2815 | CD1 | LEU A | 372 | −29.466 | 49.517 | 28.220 | 1.00 | 0.00 | XXXX | 2815 |
| ATOM | 2816 | CD2 | LEU A | 372 | −27.751 | 48.752 | 26.563 | 1.00 | 0.00 | XXXX | 2816 |
| ATOM | 2817 | N   | LYS A | 373 | −29.252 | 51.842 | 22.457 | 1.00 | 0.00 | XXXX | 2817 |
| ATOM | 2818 | CA  | LYS A | 373 | −30.097 | 52.242 | 21.338 | 1.00 | 0.00 | XXXX | 2818 |
| ATOM | 2819 | C   | LYS A | 373 | −30.630 | 51.038 | 20.571 | 1.00 | 0.00 | XXXX | 2819 |
| ATOM | 2820 | O   | LYS A | 373 | −31.702 | 51.102 | 19.970 | 1.00 | 0.00 | XXXX | 2820 |
| ATOM | 2821 | CB  | LYS A | 373 | −29.326 | 53.163 | 20.391 | 1.00 | 0.00 | XXXX | 2821 |
| ATOM | 2822 | CG  | LYS A | 373 | −28.913 | 54.485 | 21.017 | 1.00 | 0.00 | XXXX | 2822 |
| ATOM | 2823 | CD  | LYS A | 373 | −28.046 | 55.303 | 20.072 | 1.00 | 0.00 | XXXX | 2823 |
| ATOM | 2824 | CE  | LYS A | 373 | −27.328 | 56.422 | 20.811 | 1.00 | 0.00 | XXXX | 2824 |
| ATOM | 2825 | NZ  | LYS A | 373 | −26.433 | 57.200 | 19.911 | 1.00 | 0.00 | XXXX | 2825 |
| ATOM | 2826 | N   | GLY A | 374 | −29.880 | 49.941 | 20.594 | 1.00 | 0.00 | XXXX | 2826 |
| ATOM | 2827 | CA  | GLY A | 374 | −30.274 | 48.747 | 19.873 | 1.00 | 0.00 | XXXX | 2827 |
| ATOM | 2828 | C   | GLY A | 374 | −31.283 | 47.915 | 20.638 | 1.00 | 0.00 | XXXX | 2828 |
| ATOM | 2829 | O   | GLY A | 374 | −31.724 | 46.868 | 20.164 | 1.00 | 0.00 | XXXX | 2829 |
| ATOM | 2830 | N   | TYR A | 375 | −31.653 | 48.382 | 21.826 | 1.00 | 0.00 | XXXX | 2830 |
| ATOM | 2831 | CA  | TYR A | 375 | −32.598 | 47.648 | 22.657 | 1.00 | 0.00 | XXXX | 2831 |
| ATOM | 2832 | C   | TYR A | 375 | −33.868 | 48.458 | 22.858 | 1.00 | 0.00 | XXXX | 2832 |
| ATOM | 2833 | O   | TYR A | 375 | −33.907 | 49.422 | 23.625 | 1.00 | 0.00 | XXXX | 2833 |
| ATOM | 2834 | CB  | TYR A | 375 | −31.959 | 47.281 | 23.993 | 1.00 | 0.00 | XXXX | 2834 |
| ATOM | 2835 | CG  | TYR A | 375 | −30.748 | 46.400 | 23.812 | 1.00 | 0.00 | XXXX | 2835 |
| ATOM | 2836 | CD1 | TYR A | 375 | −29.484 | 46.951 | 23.669 | 1.00 | 0.00 | XXXX | 2836 |
| ATOM | 2837 | CD2 | TYR A | 375 | −30.872 | 45.018 | 23.752 | 1.00 | 0.00 | XXXX | 2837 |
| ATOM | 2838 | CE1 | TYR A | 375 | −28.374 | 46.155 | 23.490 | 1.00 | 0.00 | XXXX | 2838 |
| ATOM | 2839 | CE2 | TYR A | 375 | −29.766 | 44.210 | 23.575 | 1.00 | 0.00 | XXXX | 2839 |
| ATOM | 2840 | CZ  | TYR A | 375 | −28.519 | 44.786 | 23.444 | 1.00 | 0.00 | XXXX | 2840 |
| ATOM | 2841 | OH  | TYR A | 375 | −27.410 | 43.992 | 23.265 | 1.00 | 0.00 | XXXX | 2841 |
| ATOM | 2842 | N   | GLU A | 376 | −34.904 | 48.037 | 22.143 | 1.00 | 0.00 | XXXX | 2842 |
| ATOM | 2843 | CA  | GLU A | 376 | −36.183 | 48.727 | 22.078 | 1.00 | 0.00 | XXXX | 2843 |
| ATOM | 2844 | C   | GLU A | 376 | −36.830 | 48.884 | 23.456 | 1.00 | 0.00 | XXXX | 2844 |
| ATOM | 2845 | O   | GLU A | 376 | −37.595 | 49.819 | 23.689 | 1.00 | 0.00 | XXXX | 2845 |
| ATOM | 2846 | CB  | GLU A | 376 | −37.099 | 47.977 | 21.104 | 1.00 | 0.00 | XXXX | 2846 |
| ATOM | 2847 | CG  | GLU A | 376 | −38.423 | 48.639 | 20.804 | 1.00 | 0.00 | XXXX | 2847 |
| ATOM | 2848 | CD  | GLU A | 376 | −39.496 | 48.253 | 21.788 | 1.00 | 0.00 | XXXX | 2848 |
| ATOM | 2849 | OE1 | GLU A | 376 | −39.319 | 47.240 | 22.497 | 1.00 | 0.00 | XXXX | 2849 |
| ATOM | 2850 | OE2 | GLU A | 376 | −40.521 | 48.955 | 21.836 | 1.00 | 0.00 | XXXX | 2850 |
| ATOM | 2851 | N   | TRP A | 377 | −36.520 | 47.963 | 24.364 | 1.00 | 0.00 | XXXX | 2851 |
| ATOM | 2852 | CA  | TRP A | 377 | −37.081 | 47.983 | 25.712 | 1.00 | 0.00 | XXXX | 2852 |
| ATOM | 2853 | C   | TRP A | 377 | −36.368 | 48.959 | 26.649 | 1.00 | 0.00 | XXXX | 2853 |
| ATOM | 2854 | O   | TRP A | 377 | −36.816 | 49.185 | 27.773 | 1.00 | 0.00 | XXXX | 2854 |
| ATOM | 2855 | CB  | TRP A | 377 | −37.039 | 46.581 | 26.322 | 1.00 | 0.00 | XXXX | 2855 |
| ATOM | 2856 | CG  | TRP A | 377 | −35.684 | 45.942 | 26.250 | 1.00 | 0.00 | XXXX | 2856 |
| ATOM | 2857 | CD1 | TRP A | 377 | −35.259 | 45.029 | 25.330 | 1.00 | 0.00 | XXXX | 2857 |
| ATOM | 2858 | CD2 | TRP A | 377 | −34.568 | 46.185 | 27.118 | 1.00 | 0.00 | XXXX | 2858 |
| ATOM | 2859 | NE1 | TRP A | 377 | −33.954 | 44.679 | 25.576 | 1.00 | 0.00 | XXXX | 2859 |
| ATOM | 2860 | CE2 | TRP A | 377 | −33.507 | 45.374 | 26.668 | 1.00 | 0.00 | XXXX | 2860 |
| ATOM | 2861 | CE3 | TRP A | 377 | −34.366 | 47.004 | 28.233 | 1.00 | 0.00 | XXXX | 2861 |
| ATOM | 2862 | CZ2 | TRP A | 377 | −32.262 | 45.359 | 27.295 | 1.00 | 0.00 | XXXX | 2862 |
| ATOM | 2863 | CZ3 | TRP A | 377 | −33.128 | 46.988 | 28.853 | 1.00 | 0.00 | XXXX | 2863 |
| ATOM | 2864 | CH2 | TRP A | 377 | −32.093 | 46.170 | 28.382 | 1.00 | 0.00 | XXXX | 2864 |
| ATOM | 2865 | N   | ALA A | 378 | −35.258 | 49.530 | 26.191 | 1.00 | 0.00 | XXXX | 2865 |
| ATOM | 2866 | CA  | ALA A | 378 | −34.457 | 50.420 | 27.028 | 1.00 | 0.00 | XXXX | 2866 |
| ATOM | 2867 | C   | ALA A | 378 | −34.800 | 51.885 | 26.776 | 1.00 | 0.00 | XXXX | 2867 |
| ATOM | 2868 | O   | ALA A | 378 | −34.065 | 52.783 | 27.188 | 1.00 | 0.00 | XXXX | 2868 |
| ATOM | 2869 | CB  | ALA A | 378 | −32.975 | 50.177 | 26.790 | 1.00 | 0.00 | XXXX | 2869 |
| ATOM | 2870 | N   | GLN A | 379 | −35.916 | 52.111 | 26.089 | 1.00 | 0.00 | XXXX | 2870 |
| ATOM | 2871 | CA  | GLN A | 379 | −36.325 | 53.443 | 25.648 | 1.00 | 0.00 | XXXX | 2871 |
| ATOM | 2872 | C   | GLN A | 379 | −36.306 | 54.508 | 26.746 | 1.00 | 0.00 | XXXX | 2872 |
| ATOM | 2873 | O   | GLN A | 379 | −35.751 | 55.591 | 26.560 | 1.00 | 0.00 | XXXX | 2873 |
| ATOM | 2874 | CB  | GLN A | 379 | −37.726 | 53.374 | 25.037 | 1.00 | 0.00 | XXXX | 2874 |
| ATOM | 2875 | CG  | GLN A | 379 | −38.276 | 54.717 | 24.587 | 1.00 | 0.00 | XXXX | 2875 |
| ATOM | 2876 | CD  | GLN A | 379 | −37.534 | 55.277 | 23.390 | 1.00 | 0.00 | XXXX | 2876 |
| ATOM | 2877 | OE1 | GLN A | 379 | −37.283 | 54.570 | 22.414 | 1.00 | 0.00 | XXXX | 2877 |
| ATOM | 2878 | NE2 | GLN A | 379 | −37.180 | 56.555 | 23.459 | 1.00 | 0.00 | XXXX | 2878 |
| ATOM | 2879 | N   | GLY A | 380 | −36.914 | 54.198 | 27.887 | 1.00 | 0.00 | XXXX | 2879 |
| ATOM | 2880 | CA  | GLY A | 380 | −37.137 | 55.189 | 28.926 | 1.00 | 0.00 | XXXX | 2880 |
| ATOM | 2881 | C   | GLY A | 380 | −35.979 | 55.465 | 29.868 | 1.00 | 0.00 | XXXX | 2881 |
| ATOM | 2882 | O   | GLY A | 380 | −35.955 | 56.503 | 30.530 | 1.00 | 0.00 | XXXX | 2882 |
| ATOM | 2883 | N   | LEU A | 381 | −35.023 | 54.543 | 29.932 | 1.00 | 0.00 | XXXX | 2883 |
| ATOM | 2884 | CA  | LEU A | 381 | −33.905 | 54.648 | 30.869 | 1.00 | 0.00 | XXXX | 2884 |
| ATOM | 2885 | C   | LEU A | 381 | −33.132 | 55.956 | 30.717 | 1.00 | 0.00 | XXXX | 2885 |
| ATOM | 2886 | O   | LEU A | 381 | −32.478 | 56.191 | 29.702 | 1.00 | 0.00 | XXXX | 2886 |

-continued

| | | | | | | | | | | |
|---|---|---|---|---|---|---|---|---|---|---|
| ATOM | 2887 | CB | LEU A | 381 | −32.958 | 53.461 | 30.690 | 1.00 | 0.00 | XXXX | 2887 |
| ATOM | 2888 | CG | LEU A | 381 | −33.601 | 52.083 | 30.854 | 1.00 | 0.00 | XXXX | 2888 |
| ATOM | 2889 | CD1 | LEU A | 381 | −32.588 | 50.978 | 30.596 | 1.00 | 0.00 | XXXX | 2889 |
| ATOM | 2890 | CD2 | LEU A | 381 | −34.218 | 51.943 | 32.239 | 1.00 | 0.00 | XXXX | 2890 |
| ATOM | 2899 | N | ILE B | 15 | −6.934 | 63.095 | 62.651 | 1.00 | 0.00 | XXXX | 2899 |
| ATOM | 2900 | CA | ILE B | 15 | −5.481 | 63.191 | 62.749 | 1.00 | 0.00 | XXXX | 2900 |
| ATOM | 2901 | C | ILE B | 15 | −4.856 | 62.631 | 61.479 | 1.00 | 0.00 | XXXX | 2901 |
| ATOM | 2902 | O | ILE B | 15 | −4.893 | 61.425 | 61.238 | 1.00 | 0.00 | XXXX | 2902 |
| ATOM | 2903 | CB | ILE B | 15 | −4.922 | 62.432 | 63.964 | 1.00 | 0.00 | XXXX | 2903 |
| ATOM | 2904 | CG1 | ILE B | 15 | −5.376 | 63.089 | 65.268 | 1.00 | 0.00 | XXXX | 2904 |
| ATOM | 2905 | CG2 | ILE B | 15 | −3.402 | 62.391 | 63.907 | 1.00 | 0.00 | XXXX | 2905 |
| ATOM | 2906 | CD1 | ILE B | 15 | −5.033 | 62.282 | 66.501 | 1.00 | 0.00 | XXXX | 2906 |
| ATOM | 2907 | N | LYS B | 16 | −4.284 | 63.514 | 60.669 | 1.00 | 0.00 | XXXX | 2907 |
| ATOM | 2908 | CA | LYS B | 16 | −3.730 | 63.112 | 59.385 | 1.00 | 0.00 | XXXX | 2908 |
| ATOM | 2909 | C | LYS B | 16 | −2.339 | 62.513 | 59.550 | 1.00 | 0.00 | XXXX | 2909 |
| ATOM | 2910 | O | LYS B | 16 | −1.503 | 63.048 | 60.278 | 1.00 | 0.00 | XXXX | 2910 |
| ATOM | 2911 | CB | LYS B | 16 | −3.687 | 64.307 | 58.432 | 1.00 | 0.00 | XXXX | 2911 |
| ATOM | 2912 | CG | LYS B | 16 | −5.066 | 64.799 | 58.019 | 1.00 | 0.00 | XXXX | 2912 |
| ATOM | 2913 | CD | LYS B | 16 | −4.985 | 65.928 | 57.007 | 1.00 | 0.00 | XXXX | 2913 |
| ATOM | 2914 | CE | LYS B | 16 | −6.374 | 66.343 | 56.545 | 1.00 | 0.00 | XXXX | 2914 |
| ATOM | 2915 | NZ | LYS B | 16 | −6.325 | 67.397 | 55.496 | 1.00 | 0.00 | XXXX | 2915 |
| ATOM | 2916 | N | VAL B | 17 | −2.098 | 61.397 | 58.872 | 1.00 | 0.00 | XXXX | 2916 |
| ATOM | 2917 | CA | VAL B | 17 | −0.788 | 60.761 | 58.891 | 1.00 | 0.00 | XXXX | 2917 |
| ATOM | 2918 | C | VAL B | 17 | −0.320 | 60.505 | 57.466 | 1.00 | 0.00 | XXXX | 2918 |
| ATOM | 2919 | O | VAL B | 17 | −1.114 | 60.151 | 56.594 | 1.00 | 0.00 | XXXX | 2919 |
| ATOM | 2920 | CB | VAL B | 17 | −0.801 | 59.433 | 59.676 | 1.00 | 0.00 | XXXX | 2920 |
| ATOM | 2921 | CG1 | VAL B | 17 | −1.248 | 59.663 | 61.112 | 1.00 | 0.00 | XXXX | 2921 |
| ATOM | 2922 | CG2 | VAL B | 17 | −1.696 | 58.417 | 58.988 | 1.00 | 0.00 | XXXX | 2922 |
| ATOM | 2923 | N | GLY B | 18 | 0.971 | 60.691 | 57.230 | 1.00 | 0.00 | XXXX | 2923 |
| ATOM | 2924 | CA | GLY B | 18 | 1.517 | 60.513 | 55.901 | 1.00 | 0.00 | XXXX | 2924 |
| ATOM | 2925 | C | GLY B | 18 | 2.021 | 59.109 | 55.643 | 1.00 | 0.00 | XXXX | 2925 |
| ATOM | 2926 | O | GLY B | 18 | 2.592 | 58.467 | 56.524 | 1.00 | 0.00 | XXXX | 2926 |
| ATOM | 2927 | N | ILE B | 19 | 1.795 | 58.631 | 54.424 | 1.00 | 0.00 | XXXX | 2927 |
| ATOM | 2928 | CA | ILE B | 19 | 2.393 | 57.388 | 53.960 | 1.00 | 0.00 | XXXX | 2928 |
| ATOM | 2929 | C | ILE B | 19 | 3.189 | 57.690 | 52.698 | 1.00 | 0.00 | XXXX | 2929 |
| ATOM | 2930 | O | ILE B | 19 | 2.624 | 58.088 | 51.680 | 1.00 | 0.00 | XXXX | 2930 |
| ATOM | 2931 | CB | ILE B | 19 | 1.336 | 56.304 | 53.680 | 1.00 | 0.00 | XXXX | 2931 |
| ATOM | 2932 | CG1 | ILE B | 19 | 0.684 | 55.850 | 54.988 | 1.00 | 0.00 | XXXX | 2932 |
| ATOM | 2933 | CG2 | ILE B | 19 | 1.966 | 55.120 | 52.960 | 1.00 | 0.00 | XXXX | 2933 |
| ATOM | 2934 | CD1 | ILE B | 19 | −0.410 | 54.816 | 54.804 | 1.00 | 0.00 | XXXX | 2934 |
| ATOM | 2935 | N | LEU B | 20 | 4.501 | 57.501 | 52.767 | 1.00 | 0.00 | XXXX | 2935 |
| ATOM | 2936 | CA | LEU B | 20 | 5.383 | 57.924 | 51.689 | 1.00 | 0.00 | XXXX | 2936 |
| ATOM | 2937 | C | LEU B | 20 | 6.295 | 56.784 | 51.246 | 1.00 | 0.00 | XXXX | 2937 |
| ATOM | 2938 | O | LEU B | 20 | 7.319 | 56.508 | 51.871 | 1.00 | 0.00 | XXXX | 2938 |
| ATOM | 2939 | CB | LEU B | 20 | 6.207 | 59.135 | 52.135 | 1.00 | 0.00 | XXXX | 2939 |
| ATOM | 2940 | CG | LEU B | 20 | 7.245 | 59.684 | 51.157 | 1.00 | 0.00 | XXXX | 2940 |
| ATOM | 2941 | CD1 | LEU B | 20 | 6.599 | 60.023 | 49.823 | 1.00 | 0.00 | XXXX | 2941 |
| ATOM | 2942 | CD2 | LEU B | 20 | 7.948 | 60.897 | 51.750 | 1.00 | 0.00 | XXXX | 2942 |
| ATOM | 2943 | N | HIS B | 21 | 5.912 | 56.123 | 50.159 | 1.00 | 0.00 | XXXX | 2943 |
| ATOM | 2944 | CA | HIS B | 21 | 6.633 | 54.954 | 49.678 | 1.00 | 0.00 | XXXX | 2944 |
| ATOM | 2945 | C | HIS B | 21 | 6.710 | 54.946 | 48.160 | 1.00 | 0.00 | XXXX | 2945 |
| ATOM | 2946 | O | HIS B | 21 | 5.942 | 55.635 | 47.488 | 1.00 | 0.00 | XXXX | 2946 |
| ATOM | 2947 | CB | HIS B | 21 | 5.959 | 53.671 | 50.170 | 1.00 | 0.00 | XXXX | 2947 |
| ATOM | 2948 | CG | HIS B | 21 | 6.241 | 53.349 | 51.606 | 1.00 | 0.00 | XXXX | 2948 |
| ATOM | 2949 | ND1 | HIS B | 21 | 7.499 | 53.014 | 52.057 | 1.00 | 0.00 | XXXX | 2949 |
| ATOM | 2950 | CD2 | HIS B | 21 | 5.428 | 53.309 | 52.686 | 1.00 | 0.00 | XXXX | 2950 |
| ATOM | 2951 | CE1 | HIS B | 21 | 7.448 | 52.782 | 53.358 | 1.00 | 0.00 | XXXX | 2951 |
| ATOM | 2952 | NE2 | HIS B | 21 | 6.205 | 52.954 | 53.764 | 1.00 | 0.00 | XXXX | 2952 |
| ATOM | 2953 | N | SER B | 22 | 7.643 | 54.169 | 47.623 | 1.00 | 0.00 | XXXX | 2953 |
| ATOM | 2954 | CA | SER B | 22 | 7.728 | 53.974 | 46.183 | 1.00 | 0.00 | XXXX | 2954 |
| ATOM | 2955 | C | SER B | 22 | 6.604 | 53.061 | 45.711 | 1.00 | 0.00 | XXXX | 2955 |
| ATOM | 2956 | O | SER B | 22 | 6.669 | 51.843 | 45.884 | 1.00 | 0.00 | XXXX | 2956 |
| ATOM | 2957 | CB | SER B | 22 | 9.083 | 53.382 | 45.794 | 1.00 | 0.00 | XXXX | 2957 |
| ATOM | 2958 | OG | SER B | 22 | 10.148 | 54.213 | 46.222 | 1.00 | 0.00 | XXXX | 2958 |
| ATOM | 2959 | N | LEU B | 23 | 5.568 | 53.654 | 45.126 | 1.00 | 0.00 | XXXX | 2959 |
| ATOM | 2960 | CA | LEU B | 23 | 4.466 | 52.882 | 44.563 | 1.00 | 0.00 | XXXX | 2960 |
| ATOM | 2961 | C | LEU B | 23 | 4.692 | 52.676 | 43.071 | 1.00 | 0.00 | XXXX | 2961 |
| ATOM | 2962 | O | LEU B | 23 | 3.946 | 51.955 | 42.409 | 1.00 | 0.00 | XXXX | 2962 |
| ATOM | 2963 | CB | LEU B | 23 | 3.127 | 53.575 | 44.823 | 1.00 | 0.00 | XXXX | 2963 |
| ATOM | 2964 | CG | LEU B | 23 | 2.910 | 54.014 | 46.275 | 1.00 | 0.00 | XXXX | 2964 |
| ATOM | 2965 | CD1 | LEU B | 23 | 1.545 | 54.661 | 46.453 | 1.00 | 0.00 | XXXX | 2965 |
| ATOM | 2966 | CD2 | LEU B | 23 | 3.086 | 52.836 | 47.227 | 1.00 | 0.00 | XXXX | 2966 |
| ATOM | 2967 | N | SER B | 24 | 5.729 | 53.326 | 42.553 | 1.00 | 0.00 | XXXX | 2967 |
| ATOM | 2968 | CA | SER B | 24 | 6.172 | 53.127 | 41.179 | 1.00 | 0.00 | XXXX | 2968 |
| ATOM | 2969 | C | SER B | 24 | 7.696 | 53.111 | 41.138 | 1.00 | 0.00 | XXXX | 2969 |
| ATOM | 2970 | O | SER B | 24 | 8.352 | 53.569 | 42.073 | 1.00 | 0.00 | XXXX | 2970 |
| ATOM | 2971 | CB | SER B | 24 | 5.617 | 54.220 | 40.259 | 1.00 | 0.00 | XXXX | 2971 |
| ATOM | 2972 | OG | SER B | 24 | 6.102 | 55.501 | 40.630 | 1.00 | 0.00 | XXXX | 2972 |
| ATOM | 2973 | N | GLY B | 25 | 8.259 | 52.589 | 40.053 | 1.00 | 0.00 | XXXX | 2973 |

-continued

| | | | | | | | | | | |
|---|---|---|---|---|---|---|---|---|---|---|
| ATOM | 2974 | CA | GLY B | 25 | 9.701 | 52.541 | 39.905 | 1.00 | 0.00 | XXXX | 2974 |
| ATOM | 2975 | C | GLY B | 25 | 10.336 | 51.277 | 40.454 | 1.00 | 0.00 | XXXX | 2975 |
| ATOM | 2976 | O | GLY B | 25 | 9.648 | 50.366 | 40.911 | 1.00 | 0.00 | XXXX | 2976 |
| ATOM | 2977 | N | THR B | 26 | 11.664 | 51.233 | 40.408 | 1.00 | 0.00 | XXXX | 2977 |
| ATOM | 2978 | CA | THR B | 26 | 12.427 | 50.030 | 40.733 | 1.00 | 0.00 | XXXX | 2978 |
| ATOM | 2979 | C | THR B | 26 | 12.247 | 49.528 | 42.168 | 1.00 | 0.00 | XXXX | 2979 |
| ATOM | 2980 | O | THR B | 26 | 12.488 | 48.354 | 42.447 | 1.00 | 0.00 | XXXX | 2980 |
| ATOM | 2981 | CB | THR B | 26 | 13.931 | 50.260 | 40.492 | 1.00 | 0.00 | XXXX | 2981 |
| ATOM | 2982 | OG1 | THR B | 26 | 14.639 | 49.026 | 40.653 | 1.00 | 0.00 | XXXX | 2982 |
| ATOM | 2983 | CG2 | THR B | 26 | 14.478 | 51.289 | 41.471 | 1.00 | 0.00 | XXXX | 2983 |
| ATOM | 2984 | N | MET B | 27 | 11.832 | 50.407 | 43.074 | 1.00 | 0.00 | XXXX | 2984 |
| ATOM | 2985 | CA | MET B | 27 | 11.682 | 50.029 | 44.480 | 1.00 | 0.00 | XXXX | 2985 |
| ATOM | 2986 | C | MET B | 27 | 10.265 | 49.596 | 44.852 | 1.00 | 0.00 | XXXX | 2986 |
| ATOM | 2987 | O | MET B | 27 | 10.024 | 49.162 | 45.981 | 1.00 | 0.00 | XXXX | 2987 |
| ATOM | 2988 | CB | MET B | 27 | 12.110 | 51.186 | 45.388 | 1.00 | 0.00 | XXXX | 2988 |
| ATOM | 2989 | CG | MET B | 27 | 13.603 | 51.486 | 45.381 | 1.00 | 0.00 | XXXX | 2989 |
| ATOM | 2990 | SD | MET B | 27 | 14.614 | 50.050 | 45.796 | 1.00 | 0.00 | XXXX | 2990 |
| ATOM | 2991 | CE | MET B | 27 | 13.877 | 49.555 | 47.351 | 1.00 | 0.00 | XXXX | 2991 |
| ATOM | 2992 | N | SER B | 28 | 9.334 | 49.706 | 43.908 | 1.00 | 0.00 | XXXX | 2992 |
| ATOM | 2993 | CA | SER B | 28 | 7.927 | 49.424 | 44.192 | 1.00 | 0.00 | XXXX | 2993 |
| ATOM | 2994 | C | SER B | 28 | 7.695 | 47.954 | 44.533 | 1.00 | 0.00 | XXXX | 2994 |
| ATOM | 2995 | O | SER B | 28 | 6.741 | 47.615 | 45.233 | 1.00 | 0.00 | XXXX | 2995 |
| ATOM | 2996 | CB | SER B | 28 | 7.048 | 49.828 | 43.005 | 1.00 | 0.00 | XXXX | 2996 |
| ATOM | 2997 | OG | SER B | 28 | 7.305 | 49.012 | 41.874 | 1.00 | 0.00 | XXXX | 2997 |
| ATOM | 2998 | N | ILE B | 29 | 8.571 | 47.085 | 44.039 | 1.00 | 0.00 | XXXX | 2998 |
| ATOM | 2999 | CA | ILE B | 29 | 8.506 | 45.665 | 44.368 | 1.00 | 0.00 | XXXX | 2999 |
| ATOM | 3000 | C | ILE B | 29 | 8.567 | 45.467 | 45.880 | 1.00 | 0.00 | XXXX | 3000 |
| ATOM | 3001 | O | ILE B | 29 | 7.973 | 44.535 | 46.425 | 1.00 | 0.00 | XXXX | 3001 |
| ATOM | 3002 | CB | ILE B | 29 | 9.649 | 44.873 | 43.703 | 1.00 | 0.00 | XXXX | 3002 |
| ATOM | 3003 | CG1 | ILE B | 29 | 9.535 | 43.384 | 44.038 | 1.00 | 0.00 | XXXX | 3003 |
| ATOM | 3004 | CD1 | ILE B | 29 | 10.551 | 42.517 | 43.325 | 1.00 | 0.00 | XXXX | 3004 |
| ATOM | 3005 | CG2 | ILE B | 29 | 11.003 | 45.422 | 44.136 | 1.00 | 0.00 | XXXX | 3005 |
| ATOM | 3006 | N | SER B | 30 | 9.289 | 46.361 | 46.547 | 1.00 | 0.00 | XXXX | 3006 |
| ATOM | 3007 | CA | SER B | 30 | 9.529 | 46.253 | 47.980 | 1.00 | 0.00 | XXXX | 3007 |
| ATOM | 3008 | C | SER B | 30 | 8.563 | 47.087 | 48.821 | 1.00 | 0.00 | XXXX | 3008 |
| ATOM | 3009 | O | SER B | 30 | 8.104 | 46.637 | 49.870 | 1.00 | 0.00 | XXXX | 3009 |
| ATOM | 3010 | CB | SER B | 30 | 10.970 | 46.666 | 48.301 | 1.00 | 0.00 | XXXX | 3010 |
| ATOM | 3011 | OG | SER B | 30 | 11.897 | 45.673 | 47.895 | 1.00 | 0.00 | XXXX | 3011 |
| ATOM | 3012 | N | GLU B | 31 | 8.252 | 48.296 | 48.363 | 1.00 | 0.00 | XXXX | 3012 |
| ATOM | 3013 | CA | GLU B | 31 | 7.616 | 49.286 | 49.232 | 1.00 | 0.00 | XXXX | 3013 |
| ATOM | 3014 | C | GLU B | 31 | 6.086 | 49.296 | 49.214 | 1.00 | 0.00 | XXXX | 3014 |
| ATOM | 3015 | O | GLU B | 31 | 5.465 | 49.802 | 50.149 | 1.00 | 0.00 | XXXX | 3015 |
| ATOM | 3016 | CB | GLU B | 31 | 8.119 | 50.688 | 48.882 | 1.00 | 0.00 | XXXX | 3016 |
| ATOM | 3017 | CG | GLU B | 31 | 9.597 | 50.912 | 49.165 | 1.00 | 0.00 | XXXX | 3017 |
| ATOM | 3018 | CD | GLU B | 31 | 9.976 | 52.377 | 49.106 | 1.00 | 0.00 | XXXX | 3018 |
| ATOM | 3019 | OE1 | GLU B | 31 | 9.323 | 53.185 | 49.800 | 1.00 | 0.00 | XXXX | 3019 |
| ATOM | 3020 | OE2 | GLU B | 31 | 10.925 | 52.724 | 48.373 | 1.00 | 0.00 | XXXX | 3020 |
| ATOM | 3021 | N | VAL B | 32 | 5.476 | 48.756 | 48.164 | 1.00 | 0.00 | XXXX | 3021 |
| ATOM | 3022 | CA | VAL B | 32 | 4.018 | 48.773 | 48.073 | 1.00 | 0.00 | XXXX | 3022 |
| ATOM | 3023 | C | VAL B | 32 | 3.397 | 48.026 | 49.248 | 1.00 | 0.00 | XXXX | 3023 |
| ATOM | 3024 | O | VAL B | 32 | 2.392 | 48.464 | 49.810 | 1.00 | 0.00 | XXXX | 3024 |
| ATOM | 3025 | CB | VAL B | 32 | 3.514 | 48.161 | 46.755 | 1.00 | 0.00 | XXXX | 3025 |
| ATOM | 3026 | CG1 | VAL B | 32 | 2.015 | 47.890 | 46.836 | 1.00 | 0.00 | XXXX | 3026 |
| ATOM | 3027 | CG2 | VAL B | 32 | 3.830 | 49.088 | 45.590 | 1.00 | 0.00 | XXXX | 3027 |
| ATOM | 3028 | N | SER B | 33 | 4.007 | 46.904 | 49.620 | 1.00 | 0.00 | XXXX | 3028 |
| ATOM | 3029 | CA | SER B | 33 | 3.506 | 46.087 | 50.721 | 1.00 | 0.00 | XXXX | 3029 |
| ATOM | 3030 | C | SER B | 33 | 3.689 | 46.775 | 52.074 | 1.00 | 0.00 | XXXX | 3030 |
| ATOM | 3031 | O | SER B | 33 | 2.996 | 46.449 | 53.039 | 1.00 | 0.00 | XXXX | 3031 |
| ATOM | 3032 | CB | SER B | 33 | 4.195 | 44.721 | 50.730 | 1.00 | 0.00 | XXXX | 3032 |
| ATOM | 3033 | OG | SER B | 33 | 5.600 | 44.855 | 50.859 | 1.00 | 0.00 | XXXX | 3033 |
| ATOM | 3034 | N | LEU B | 34 | 4.616 | 47.727 | 52.144 | 1.00 | 0.00 | XXXX | 3034 |
| ATOM | 3035 | CA | LEU B | 34 | 4.786 | 48.523 | 53.355 | 1.00 | 0.00 | XXXX | 3035 |
| ATOM | 3036 | C | LEU B | 34 | 3.610 | 49.474 | 53.526 | 1.00 | 0.00 | XXXX | 3036 |
| ATOM | 3037 | O | LEU B | 34 | 3.131 | 49.687 | 54.640 | 1.00 | 0.00 | XXXX | 3037 |
| ATOM | 3038 | CB | LEU B | 34 | 6.100 | 49.306 | 53.328 | 1.00 | 0.00 | XXXX | 3038 |
| ATOM | 3039 | CG | LEU B | 34 | 7.388 | 48.485 | 53.284 | 1.00 | 0.00 | XXXX | 3039 |
| ATOM | 3040 | CD1 | LEU B | 34 | 7.287 | 47.288 | 54.213 | 1.00 | 0.00 | XXXX | 3040 |
| ATOM | 3041 | CD2 | LEU B | 34 | 8.576 | 49.359 | 53.661 | 1.00 | 0.00 | XXXX | 3041 |
| ATOM | 3042 | N | LYS B | 35 | 3.157 | 50.051 | 52.417 | 1.00 | 0.00 | XXXX | 3042 |
| ATOM | 3043 | CA | LYS B | 35 | 1.946 | 50.863 | 52.417 | 1.00 | 0.00 | XXXX | 3043 |
| ATOM | 3044 | C | LYS B | 35 | 0.760 | 50.041 | 52.916 | 1.00 | 0.00 | XXXX | 3044 |
| ATOM | 3045 | O | LYS B | 35 | −0.058 | 50.527 | 53.695 | 1.00 | 0.00 | XXXX | 3045 |
| ATOM | 3046 | CB | LYS B | 35 | 1.657 | 51.413 | 51.018 | 1.00 | 0.00 | XXXX | 3046 |
| ATOM | 3047 | CG | LYS B | 35 | 0.312 | 52.113 | 50.894 | 1.00 | 0.00 | XXXX | 3047 |
| ATOM | 3048 | CD | LYS B | 35 | −0.269 | 51.942 | 49.500 | 1.00 | 0.00 | XXXX | 3048 |
| ATOM | 3049 | CE | LYS B | 35 | −0.580 | 50.483 | 49.216 | 1.00 | 0.00 | XXXX | 3049 |
| ATOM | 3050 | NZ | LYS B | 35 | −1.406 | 50.319 | 47.989 | 1.00 | 0.00 | XXXX | 3050 |
| ATOM | 3051 | N | ASP B | 36 | 0.678 | 48.794 | 52.457 | 1.00 | 0.00 | XXXX | 3051 |
| ATOM | 3052 | CA | ASP B | 36 | −0.389 | 47.882 | 52.864 | 1.00 | 0.00 | XXXX | 3052 |

-continued

| | | | | | | | | | | |
|---|---|---|---|---|---|---|---|---|---|---|
| ATOM | 3053 | C | ASP B | 36 | −0.330 | 47.587 | 54.360 | 1.00 | 0.00 | XXXX | 3053 |
| ATOM | 3054 | O | ASP B | 36 | −1.355 | 47.572 | 55.043 | 1.00 | 0.00 | XXXX | 3054 |
| ATOM | 3055 | CB | ASP B | 36 | −0.308 | 46.570 | 52.079 | 1.00 | 0.00 | XXXX | 3055 |
| ATOM | 3056 | CG | ASP B | 36 | −0.647 | 46.742 | 50.610 | 1.00 | 0.00 | XXXX | 3056 |
| ATOM | 3057 | OD1 | ASP B | 36 | −1.333 | 47.727 | 50.264 | 1.00 | 0.00 | XXXX | 3057 |
| ATOM | 3058 | OD2 | ASP B | 36 | −0.229 | 45.886 | 49.801 | 1.00 | 0.00 | XXXX | 3058 |
| ATOM | 3059 | N | ALA B | 37 | 0.879 | 47.353 | 54.862 | 1.00 | 0.00 | XXXX | 3059 |
| ATOM | 3060 | CA | ALA B | 37 | 1.080 | 47.054 | 56.276 | 1.00 | 0.00 | XXXX | 3060 |
| ATOM | 3061 | C | ALA B | 37 | 0.661 | 48.226 | 57.157 | 1.00 | 0.00 | XXXX | 3061 |
| ATOM | 3062 | O | ALA B | 37 | −0.002 | 48.041 | 58.177 | 1.00 | 0.00 | XXXX | 3062 |
| ATOM | 3063 | CB | ALA B | 37 | 2.533 | 46.689 | 56.538 | 1.00 | 0.00 | XXXX | 3063 |
| ATOM | 3064 | N | GLU B | 38 | 1.057 | 49.430 | 56.761 | 1.00 | 0.00 | XXXX | 3064 |
| ATOM | 3065 | CA | GLU B | 38 | 0.739 | 50.630 | 57.527 | 1.00 | 0.00 | XXXX | 3065 |
| ATOM | 3066 | C | GLU B | 38 | −0.760 | 50.917 | 57.526 | 1.00 | 0.00 | XXXX | 3066 |
| ATOM | 3067 | O | GLU B | 38 | −1.323 | 51.331 | 58.540 | 1.00 | 0.00 | XXXX | 3067 |
| ATOM | 3068 | CB | GLU B | 38 | 1.507 | 51.833 | 56.978 | 1.00 | 0.00 | XXXX | 3068 |
| ATOM | 3069 | CG | GLU B | 38 | 3.015 | 51.739 | 57.166 | 1.00 | 0.00 | XXXX | 3069 |
| ATOM | 3070 | CD | GLU B | 38 | 3.787 | 52.455 | 56.075 | 1.00 | 0.00 | XXXX | 3070 |
| ATOM | 3071 | OE1 | GLU B | 38 | 3.145 | 53.033 | 55.174 | 1.00 | 0.00 | XXXX | 3071 |
| ATOM | 3072 | OE2 | GLU B | 38 | 5.036 | 52.442 | 56.120 | 1.00 | 0.00 | XXXX | 3072 |
| ATOM | 3073 | N | LEU B | 39 | −1.407 | 50.692 | 56.387 | 1.00 | 0.00 | XXXX | 3073 |
| ATOM | 3074 | CA | LEU B | 39 | −2.841 | 50.939 | 56.273 | 1.00 | 0.00 | XXXX | 3074 |
| ATOM | 3075 | C | LEU B | 39 | −3.650 | 49.961 | 57.119 | 1.00 | 0.00 | XXXX | 3075 |
| ATOM | 3076 | O | LEU B | 39 | −4.701 | 50.316 | 57.653 | 1.00 | 0.00 | XXXX | 3076 |
| ATOM | 3077 | CB | LEU B | 39 | −3.285 | 50.859 | 54.812 | 1.00 | 0.00 | XXXX | 3077 |
| ATOM | 3078 | CG | LEU B | 39 | −2.901 | 52.043 | 53.922 | 1.00 | 0.00 | XXXX | 3078 |
| ATOM | 3079 | CD1 | LEU B | 39 | −3.270 | 51.771 | 52.470 | 1.00 | 0.00 | XXXX | 3079 |
| ATOM | 3080 | CD2 | LEU B | 39 | −3.562 | 53.321 | 54.418 | 1.00 | 0.00 | XXXX | 3080 |
| ATOM | 3081 | N | MET B | 40 | −3.161 | 48.730 | 57.237 | 1.00 | 0.00 | XXXX | 3081 |
| ATOM | 3082 | CA | MET B | 40 | −3.824 | 47.727 | 58.063 | 1.00 | 0.00 | XXXX | 3082 |
| ATOM | 3083 | C | MET B | 40 | −3.760 | 48.120 | 59.535 | 1.00 | 0.00 | XXXX | 3083 |
| ATOM | 3084 | O | MET B | 40 | −4.758 | 48.043 | 60.252 | 1.00 | 0.00 | XXXX | 3084 |
| ATOM | 3085 | CB | MET B | 40 | −3.201 | 46.347 | 57.856 | 1.00 | 0.00 | XXXX | 3085 |
| ATOM | 3086 | CG | MET B | 40 | −3.923 | 45.242 | 58.611 | 1.00 | 0.00 | XXXX | 3086 |
| ATOM | 3087 | SD | MET B | 40 | −3.281 | 43.595 | 58.269 | 1.00 | 0.00 | XXXX | 3087 |
| ATOM | 3088 | CE | MET B | 40 | −1.684 | 43.687 | 59.071 | 1.00 | 0.00 | XXXX | 3088 |
| ATOM | 3089 | N | ALA B | 41 | −2.576 | 48.530 | 59.981 | 1.00 | 0.00 | XXXX | 3089 |
| ATOM | 3090 | CA | ALA B | 41 | −2.390 | 48.986 | 61.353 | 1.00 | 0.00 | XXXX | 3090 |
| ATOM | 3091 | C | ALA B | 41 | −3.297 | 50.176 | 61.650 | 1.00 | 0.00 | XXXX | 3091 |
| ATOM | 3092 | O | ALA B | 41 | −3.935 | 50.238 | 62.701 | 1.00 | 0.00 | XXXX | 3092 |
| ATOM | 3093 | CB | ALA B | 41 | −0.933 | 49.349 | 61.600 | 1.00 | 0.00 | XXXX | 3093 |
| ATOM | 3094 | N | ILE B | 42 | −3.347 | 51.118 | 60.712 | 1.00 | 0.00 | XXXX | 3094 |
| ATOM | 3095 | CA | ILE B | 42 | −4.214 | 52.284 | 60.832 | 1.00 | 0.00 | XXXX | 3095 |
| ATOM | 3096 | C | ILE B | 42 | −5.686 | 51.889 | 60.920 | 1.00 | 0.00 | XXXX | 3096 |
| ATOM | 3097 | O | ILE B | 42 | −6.435 | 52.436 | 61.729 | 1.00 | 0.00 | XXXX | 3097 |
| ATOM | 3098 | CB | ILE B | 42 | −4.022 | 53.249 | 59.650 | 1.00 | 0.00 | XXXX | 3098 |
| ATOM | 3099 | CG1 | ILE B | 42 | −2.639 | 53.904 | 59.719 | 1.00 | 0.00 | XXXX | 3099 |
| ATOM | 3100 | CD1 | ILE B | 42 | −2.271 | 54.684 | 58.476 | 1.00 | 0.00 | XXXX | 3100 |
| ATOM | 3101 | CG2 | ILE B | 42 | −5.116 | 54.306 | 59.645 | 1.00 | 0.00 | XXXX | 3101 |
| ATOM | 3102 | N | GLU B | 43 | −6.100 | 50.942 | 60.084 | 1.00 | 0.00 | XXXX | 3102 |
| ATOM | 3103 | CA | GLU B | 43 | −7.484 | 50.478 | 60.096 | 1.00 | 0.00 | XXXX | 3103 |
| ATOM | 3104 | C | GLU B | 43 | −7.824 | 49.823 | 61.429 | 1.00 | 0.00 | XXXX | 3104 |
| ATOM | 3105 | O | GLU B | 43 | −8.913 | 50.023 | 61.971 | 1.00 | 0.00 | XXXX | 3105 |
| ATOM | 3106 | CB | GLU B | 43 | −7.742 | 49.498 | 58.950 | 1.00 | 0.00 | XXXX | 3106 |
| ATOM | 3107 | CG | GLU B | 43 | −9.146 | 48.906 | 58.958 | 1.00 | 0.00 | XXXX | 3107 |
| ATOM | 3108 | CD | GLU B | 43 | −9.402 | 47.980 | 57.784 | 1.00 | 0.00 | XXXX | 3108 |
| ATOM | 3109 | OE1 | GLU B | 43 | −8.695 | 46.957 | 57.663 | 1.00 | 0.00 | XXXX | 3109 |
| ATOM | 3110 | OE2 | GLU B | 43 | −10.314 | 48.275 | 56.983 | 1.00 | 0.00 | XXXX | 3110 |
| ATOM | 3111 | N | GLU B | 44 | −6.890 | 49.032 | 61.948 | 1.00 | 0.00 | XXXX | 3111 |
| ATOM | 3112 | CA | GLU B | 44 | −7.076 | 48.361 | 63.230 | 1.00 | 0.00 | XXXX | 3112 |
| ATOM | 3113 | C | GLU B | 44 | −7.241 | 49.366 | 64.365 | 1.00 | 0.00 | XXXX | 3113 |
| ATOM | 3114 | O | GLU B | 44 | −8.156 | 49.250 | 65.181 | 1.00 | 0.00 | XXXX | 3114 |
| ATOM | 3115 | CB | GLU B | 44 | −5.900 | 47.425 | 63.524 | 1.00 | 0.00 | XXXX | 3115 |
| ATOM | 3116 | CG | GLU B | 44 | −5.817 | 46.225 | 62.595 | 1.00 | 0.00 | XXXX | 3116 |
| ATOM | 3117 | CD | GLU B | 44 | −4.617 | 45.344 | 62.885 | 1.00 | 0.00 | XXXX | 3117 |
| ATOM | 3118 | OE1 | GLU B | 44 | −3.835 | 45.685 | 63.796 | 1.00 | 0.00 | XXXX | 3118 |
| ATOM | 3119 | OE2 | GLU B | 44 | −4.455 | 44.313 | 62.200 | 1.00 | 0.00 | XXXX | 3119 |
| ATOM | 3120 | N | ILE B | 45 | −6.349 | 50.350 | 64.409 | 1.00 | 0.00 | XXXX | 3120 |
| ATOM | 3121 | CA | ILE B | 45 | −6.390 | 51.381 | 65.439 | 1.00 | 0.00 | XXXX | 3121 |
| ATOM | 3122 | C | ILE B | 45 | −7.672 | 52.212 | 65.364 | 1.00 | 0.00 | XXXX | 3122 |
| ATOM | 3123 | O | ILE B | 45 | −8.257 | 52.551 | 66.392 | 1.00 | 0.00 | XXXX | 3123 |
| ATOM | 3124 | CB | ILE B | 45 | −5.168 | 52.313 | 65.342 | 1.00 | 0.00 | XXXX | 3124 |
| ATOM | 3125 | CG1 | ILE B | 45 | −3.891 | 51.545 | 65.700 | 1.00 | 0.00 | XXXX | 3125 |
| ATOM | 3126 | CD1 | ILE B | 45 | −2.613 | 52.292 | 65.379 | 1.00 | 0.00 | XXXX | 3126 |
| ATOM | 3127 | CG2 | ILE B | 45 | −5.345 | 53.522 | 66.248 | 1.00 | 0.00 | XXXX | 3127 |
| ATOM | 3128 | N | ASN B | 46 | −8.105 | 52.539 | 64.150 | 1.00 | 0.00 | XXXX | 3128 |
| ATOM | 3129 | CA | ASN B | 46 | −9.337 | 53.300 | 63.964 | 1.00 | 0.00 | XXXX | 3129 |
| ATOM | 3130 | C | ASN B | 46 | −10.568 | 52.530 | 64.433 | 1.00 | 0.00 | XXXX | 3130 |
| ATOM | 3131 | O | ASN B | 46 | −11.484 | 53.105 | 65.021 | 1.00 | 0.00 | XXXX | 3131 |

-continued

| | | | | | | | | | | |
|---|---|---|---|---|---|---|---|---|---|---|
| ATOM | 3132 | CB | ASN B | 46 | −9.508 | 53.702 | 62.497 | 1.00 | 0.00 | XXXX | 3132 |
| ATOM | 3133 | CG | ASN B | 46 | −8.645 | 54.890 | 62.112 | 1.00 | 0.00 | XXXX | 3133 |
| ATOM | 3134 | OD1 | ASN B | 46 | −8.218 | 55.664 | 62.968 | 1.00 | 0.00 | XXXX | 3134 |
| ATOM | 3135 | ND2 | ASN B | 46 | −8.387 | 55.041 | 60.817 | 1.00 | 0.00 | XXXX | 3135 |
| ATOM | 3136 | N | ASN B | 47 | −10.583 | 51.228 | 64.170 | 1.00 | 0.00 | XXXX | 3136 |
| ATOM | 3137 | CA | ASN B | 47 | −11.700 | 50.385 | 64.578 | 1.00 | 0.00 | XXXX | 3137 |
| ATOM | 3138 | C | ASN B | 47 | −11.779 | 50.208 | 66.092 | 1.00 | 0.00 | XXXX | 3138 |
| ATOM | 3139 | O | ASN B | 47 | −12.835 | 49.871 | 66.626 | 1.00 | 0.00 | XXXX | 3139 |
| ATOM | 3140 | CB | ASN B | 47 | −11.609 | 49.017 | 63.897 | 1.00 | 0.00 | XXXX | 3140 |
| ATOM | 3141 | CG | ASN B | 47 | −11.884 | 49.090 | 62.408 | 1.00 | 0.00 | XXXX | 3141 |
| ATOM | 3142 | OD1 | ASN B | 47 | −12.461 | 50.061 | 61.918 | 1.00 | 0.00 | XXXX | 3142 |
| ATOM | 3143 | ND2 | ASN B | 47 | −11.472 | 48.059 | 61.679 | 1.00 | 0.00 | XXXX | 3143 |
| ATOM | 3144 | N | ASN B | 48 | −10.663 | 50.435 | 66.778 | 1.00 | 0.00 | XXXX | 3144 |
| ATOM | 3145 | CA | ASN B | 48 | −10.632 | 50.351 | 68.237 | 1.00 | 0.00 | XXXX | 3145 |
| ATOM | 3146 | C | ASN B | 48 | −10.850 | 51.701 | 68.913 | 1.00 | 0.00 | XXXX | 3146 |
| ATOM | 3147 | O | ASN B | 48 | −10.627 | 51.842 | 70.115 | 1.00 | 0.00 | XXXX | 3147 |
| ATOM | 3148 | CB | ASN B | 48 | −9.309 | 49.745 | 68.713 | 1.00 | 0.00 | XXXX | 3148 |
| ATOM | 3149 | CG | ASN B | 48 | −9.218 | 48.257 | 68.440 | 1.00 | 0.00 | XXXX | 3149 |
| ATOM | 3150 | OD1 | ASN B | 48 | −10.178 | 47.640 | 67.978 | 1.00 | 0.00 | XXXX | 3150 |
| ATOM | 3151 | ND2 | ASN B | 48 | −8.063 | 47.670 | 68.735 | 1.00 | 0.00 | XXXX | 3151 |
| ATOM | 3152 | N | GLY B | 49 | −11.289 | 52.690 | 68.142 | 1.00 | 0.00 | XXXX | 3152 |
| ATOM | 3153 | CA | GLY B | 49 | −11.579 | 54.003 | 68.690 | 1.00 | 0.00 | XXXX | 3153 |
| ATOM | 3154 | C | GLY B | 49 | −10.520 | 55.054 | 68.413 | 1.00 | 0.00 | XXXX | 3154 |
| ATOM | 3155 | O | GLY B | 49 | −10.577 | 56.158 | 68.954 | 1.00 | 0.00 | XXXX | 3155 |
| ATOM | 3156 | N | GLY B | 50 | −9.553 | 54.717 | 67.567 | 1.00 | 0.00 | XXXX | 3156 |
| ATOM | 3157 | CA | GLY B | 50 | −8.566 | 55.681 | 67.113 | 1.00 | 0.00 | XXXX | 3157 |
| ATOM | 3158 | C | GLY B | 50 | −7.608 | 56.193 | 68.173 | 1.00 | 0.00 | XXXX | 3158 |
| ATOM | 3159 | O | GLY B | 50 | −7.261 | 55.478 | 69.114 | 1.00 | 0.00 | XXXX | 3159 |
| ATOM | 3160 | N | VAL B | 51 | −7.179 | 57.443 | 68.013 | 1.00 | 0.00 | XXXX | 3160 |
| ATOM | 3161 | CA | VAL B | 51 | −6.139 | 58.026 | 68.855 | 1.00 | 0.00 | XXXX | 3161 |
| ATOM | 3162 | C | VAL B | 51 | −6.572 | 59.380 | 69.407 | 1.00 | 0.00 | XXXX | 3162 |
| ATOM | 3163 | O | VAL B | 51 | −6.934 | 60.279 | 68.650 | 1.00 | 0.00 | XXXX | 3163 |
| ATOM | 3164 | CB | VAL B | 51 | −4.818 | 58.197 | 68.079 | 1.00 | 0.00 | XXXX | 3164 |
| ATOM | 3165 | CG1 | VAL B | 51 | −3.811 | 58.976 | 68.911 | 1.00 | 0.00 | XXXX | 3165 |
| ATOM | 3166 | CG2 | VAL B | 51 | −4.257 | 56.843 | 67.682 | 1.00 | 0.00 | XXXX | 3166 |
| ATOM | 3167 | N | LEU B | 52 | −6.518 | 59.516 | 70.730 | 1.00 | 0.00 | XXXX | 3167 |
| ATOM | 3168 | CA | LEU B | 52 | −6.982 | 60.721 | 71.412 | 1.00 | 0.00 | XXXX | 3168 |
| ATOM | 3169 | C | LEU B | 52 | −8.408 | 61.078 | 70.999 | 1.00 | 0.00 | XXXX | 3169 |
| ATOM | 3170 | O | LEU B | 52 | −8.753 | 62.252 | 70.872 | 1.00 | 0.00 | XXXX | 3170 |
| ATOM | 3171 | CB | LEU B | 52 | −6.045 | 61.901 | 71.131 | 1.00 | 0.00 | XXXX | 3171 |
| ATOM | 3172 | CG | LEU B | 52 | −4.582 | 61.766 | 71.562 | 1.00 | 0.00 | XXXX | 3172 |
| ATOM | 3173 | CD1 | LEU B | 52 | −3.815 | 63.039 | 71.233 | 1.00 | 0.00 | XXXX | 3173 |
| ATOM | 3174 | CD2 | LEU B | 52 | −4.475 | 61.446 | 73.046 | 1.00 | 0.00 | XXXX | 3174 |
| ATOM | 3175 | N | GLY B | 53 | −9.234 | 60.056 | 70.794 | 1.00 | 0.00 | XXXX | 3175 |
| ATOM | 3176 | CA | GLY B | 53 | −10.622 | 60.257 | 70.420 | 1.00 | 0.00 | XXXX | 3176 |
| ATOM | 3177 | C | GLY B | 53 | −10.813 | 60.660 | 68.969 | 1.00 | 0.00 | XXXX | 3177 |
| ATOM | 3178 | O | GLY B | 53 | −11.910 | 61.044 | 68.565 | 1.00 | 0.00 | XXXX | 3178 |
| ATOM | 3179 | N | LYS B | 54 | −9.748 | 60.562 | 68.179 | 1.00 | 0.00 | XXXX | 3179 |
| ATOM | 3180 | CA | LYS B | 54 | −9.816 | 60.902 | 66.761 | 1.00 | 0.00 | XXXX | 3180 |
| ATOM | 3181 | C | LYS B | 54 | −9.420 | 59.716 | 65.890 | 1.00 | 0.00 | XXXX | 3181 |
| ATOM | 3182 | O | LYS B | 54 | −8.609 | 58.883 | 66.293 | 1.00 | 0.00 | XXXX | 3182 |
| ATOM | 3183 | CB | LYS B | 54 | −8.908 | 62.095 | 66.446 | 1.00 | 0.00 | XXXX | 3183 |
| ATOM | 3184 | CG | LYS B | 54 | −9.235 | 63.372 | 67.201 | 1.00 | 0.00 | XXXX | 3184 |
| ATOM | 3185 | CD | LYS B | 54 | −8.211 | 64.453 | 66.885 | 1.00 | 0.00 | XXXX | 3185 |
| ATOM | 3186 | CE | LYS B | 54 | −8.517 | 65.756 | 67.606 | 1.00 | 0.00 | XXXX | 3186 |
| ATOM | 3187 | NZ | LYS B | 54 | −9.781 | 66.379 | 67.130 | 1.00 | 0.00 | XXXX | 3187 |
| ATOM | 3188 | N | LYS B | 55 | −9.994 | 59.643 | 64.694 | 1.00 | 0.00 | XXXX | 3188 |
| ATOM | 3189 | CA | LYS B | 55 | −9.595 | 58.629 | 63.725 | 1.00 | 0.00 | XXXX | 3189 |
| ATOM | 3190 | C | LYS B | 55 | −8.370 | 59.094 | 62.952 | 1.00 | 0.00 | XXXX | 3190 |
| ATOM | 3191 | O | LYS B | 55 | −8.167 | 60.292 | 62.757 | 1.00 | 0.00 | XXXX | 3191 |
| ATOM | 3192 | CB | LYS B | 55 | −10.741 | 58.310 | 62.763 | 1.00 | 0.00 | XXXX | 3192 |
| ATOM | 3193 | CG | LYS B | 55 | −11.954 | 57.678 | 63.429 | 1.00 | 0.00 | XXXX | 3193 |
| ATOM | 3194 | CD | LYS B | 55 | −11.535 | 56.552 | 64.363 | 1.00 | 0.00 | XXXX | 3194 |
| ATOM | 3195 | CE | LYS B | 55 | −12.735 | 55.922 | 65.046 | 1.00 | 0.00 | XXXX | 3195 |
| ATOM | 3196 | NZ | LYS B | 55 | −13.631 | 55.247 | 64.066 | 1.00 | 0.00 | XXXX | 3196 |
| ATOM | 3197 | N | LEU B | 56 | −7.555 | 58.142 | 62.512 | 1.00 | 0.00 | XXXX | 3197 |
| ATOM | 3198 | CA | LEU B | 56 | −6.387 | 58.457 | 61.701 | 1.00 | 0.00 | XXXX | 3198 |
| ATOM | 3199 | C | LEU B | 56 | −6.762 | 58.515 | 60.225 | 1.00 | 0.00 | XXXX | 3199 |
| ATOM | 3200 | O | LEU B | 56 | −7.447 | 57.628 | 59.717 | 1.00 | 0.00 | XXXX | 3200 |
| ATOM | 3201 | CB | LEU B | 56 | −5.284 | 57.423 | 61.930 | 1.00 | 0.00 | XXXX | 3201 |
| ATOM | 3202 | CG | LEU B | 56 | −4.871 | 57.206 | 63.388 | 1.00 | 0.00 | XXXX | 3202 |
| ATOM | 3203 | CD1 | LEU B | 56 | −3.931 | 56.015 | 63.509 | 1.00 | 0.00 | XXXX | 3203 |
| ATOM | 3204 | CD2 | LEU B | 56 | −4.236 | 58.463 | 63.967 | 1.00 | 0.00 | XXXX | 3204 |
| ATOM | 3205 | N | GLU B | 57 | −6.313 | 59.564 | 59.544 | 1.00 | 0.00 | XXXX | 3205 |
| ATOM | 3206 | CA | GLU B | 57 | −6.571 | 59.720 | 58.116 | 1.00 | 0.00 | XXXX | 3206 |
| ATOM | 3207 | C | GLU B | 57 | −5.266 | 59.688 | 57.334 | 1.00 | 0.00 | XXXX | 3207 |
| ATOM | 3208 | O | GLU B | 57 | −4.501 | 60.651 | 57.356 | 1.00 | 0.00 | XXXX | 3208 |
| ATOM | 3209 | CB | GLU B | 57 | −7.317 | 61.027 | 57.837 | 1.00 | 0.00 | XXXX | 3209 |
| ATOM | 3210 | CG | GLU B | 57 | −7.524 | 61.313 | 56.358 | 1.00 | 0.00 | XXXX | 3210 |

-continued

| ATOM | 3211 | CD | GLU B | 57 | −8.311 | 62.585 | 56.113 | 1.00 | 0.00 | XXXX | 3211 |
| --- | --- | --- | --- | --- | --- | --- | --- | --- | --- | --- | --- |
| ATOM | 3212 | OE1 | GLU B | 57 | −8.642 | 63.280 | 57.096 | 1.00 | 0.00 | XXXX | 3212 |
| ATOM | 3213 | OE2 | GLU B | 57 | −8.599 | 62.889 | 54.937 | 1.00 | 0.00 | XXXX | 3213 |
| ATOM | 3214 | N | PRO B | 58 | −5.010 | 58.578 | 56.631 | 1.00 | 0.00 | XXXX | 3214 |
| ATOM | 3215 | CA | PRO B | 58 | −3.751 | 58.443 | 55.893 | 1.00 | 0.00 | XXXX | 3215 |
| ATOM | 3216 | C | PRO B | 58 | −3.722 | 59.278 | 54.617 | 1.00 | 0.00 | XXXX | 3216 |
| ATOM | 3217 | O | PRO B | 58 | −4.693 | 59.299 | 53.859 | 1.00 | 0.00 | XXXX | 3217 |
| ATOM | 3218 | CB | PRO B | 58 | −3.697 | 56.949 | 55.568 | 1.00 | 0.00 | XXXX | 3218 |
| ATOM | 3219 | CG | PRO B | 58 | −5.124 | 56.521 | 55.524 | 1.00 | 0.00 | XXXX | 3219 |
| ATOM | 3220 | CD | PRO B | 58 | −5.867 | 57.386 | 56.506 | 1.00 | 0.00 | XXXX | 3220 |
| ATOM | 3221 | N | ILE B | 59 | −2.606 | 59.964 | 54.393 | 1.00 | 0.00 | XXXX | 3221 |
| ATOM | 3222 | CA | ILE B | 59 | −2.379 | 60.686 | 53.150 | 1.00 | 0.00 | XXXX | 3222 |
| ATOM | 3223 | C | ILE B | 59 | −1.254 | 59.984 | 52.403 | 1.00 | 0.00 | XXXX | 3223 |
| ATOM | 3224 | O | ILE B | 59 | −0.088 | 60.097 | 52.778 | 1.00 | 0.00 | XXXX | 3224 |
| ATOM | 3225 | CB | ILE B | 59 | −2.005 | 62.160 | 53.397 | 1.00 | 0.00 | XXXX | 3225 |
| ATOM | 3226 | CG1 | ILE B | 59 | −3.009 | 62.820 | 54.347 | 1.00 | 0.00 | XXXX | 3226 |
| ATOM | 3227 | CD1 | ILE B | 59 | −4.429 | 62.842 | 53.826 | 1.00 | 0.00 | XXXX | 3227 |
| ATOM | 3228 | CG2 | ILE B | 59 | −1.910 | 62.918 | 52.080 | 1.00 | 0.00 | XXXX | 3228 |
| ATOM | 3229 | N | VAL B | 60 | −1.609 | 59.261 | 51.346 | 1.00 | 0.00 | XXXX | 3229 |
| ATOM | 3230 | CA | VAL B | 60 | −0.652 | 58.413 | 50.646 | 1.00 | 0.00 | XXXX | 3230 |
| ATOM | 3231 | C | VAL B | 60 | −0.006 | 59.124 | 49.464 | 1.00 | 0.00 | XXXX | 3231 |
| ATOM | 3232 | O | VAL B | 60 | −0.694 | 59.669 | 48.601 | 1.00 | 0.00 | XXXX | 3232 |
| ATOM | 3233 | CB | VAL B | 60 | −1.320 | 57.119 | 50.147 | 1.00 | 0.00 | XXXX | 3233 |
| ATOM | 3234 | CG1 | VAL B | 60 | −0.333 | 56.288 | 49.344 | 1.00 | 0.00 | XXXX | 3234 |
| ATOM | 3235 | CG2 | VAL B | 60 | −1.860 | 56.321 | 51.321 | 1.00 | 0.00 | XXXX | 3235 |
| ATOM | 3236 | N | GLU B | 61 | 1.323 | 59.113 | 49.436 | 1.00 | 0.00 | XXXX | 3236 |
| ATOM | 3237 | CA | GLU B | 61 | 2.081 | 59.757 | 48.370 | 1.00 | 0.00 | XXXX | 3237 |
| ATOM | 3238 | C | GLU B | 61 | 3.098 | 58.801 | 47.751 | 1.00 | 0.00 | XXXX | 3238 |
| ATOM | 3239 | O | GLU B | 61 | 3.772 | 58.051 | 48.458 | 1.00 | 0.00 | XXXX | 3239 |
| ATOM | 3240 | CB | GLU B | 61 | 2.794 | 61.006 | 48.898 | 1.00 | 0.00 | XXXX | 3240 |
| ATOM | 3241 | CG | GLU B | 61 | 1.860 | 62.099 | 49.395 | 1.00 | 0.00 | XXXX | 3241 |
| ATOM | 3242 | CD | GLU B | 61 | 1.031 | 62.713 | 48.282 | 1.00 | 0.00 | XXXX | 3242 |
| ATOM | 3243 | OE1 | GLU B | 61 | 1.485 | 62.695 | 47.119 | 1.00 | 0.00 | XXXX | 3243 |
| ATOM | 3244 | OE2 | GLU B | 61 | −0.076 | 63.213 | 48.572 | 1.00 | 0.00 | XXXX | 3244 |
| ATOM | 3245 | N | ASP B | 62 | 3.200 | 58.829 | 46.427 | 1.00 | 0.00 | XXXX | 3245 |
| ATOM | 3246 | CA | ASP B | 62 | 4.181 | 58.020 | 45.714 | 1.00 | 0.00 | XXXX | 3246 |
| ATOM | 3247 | C | ASP B | 62 | 5.544 | 58.710 | 45.711 | 1.00 | 0.00 | XXXX | 3247 |
| ATOM | 3248 | O | ASP B | 62 | 5.679 | 59.826 | 45.212 | 1.00 | 0.00 | XXXX | 3248 |
| ATOM | 3249 | CB | ASP B | 62 | 3.710 | 57.752 | 44.280 | 1.00 | 0.00 | XXXX | 3249 |
| ATOM | 3250 | CG | ASP B | 62 | 4.700 | 56.923 | 43.481 | 1.00 | 0.00 | XXXX | 3250 |
| ATOM | 3251 | OD1 | ASP B | 62 | 5.525 | 56.215 | 44.096 | 1.00 | 0.00 | XXXX | 3251 |
| ATOM | 3252 | OD2 | ASP B | 62 | 4.653 | 56.981 | 42.233 | 1.00 | 0.00 | XXXX | 3252 |
| ATOM | 3253 | N | GLY B | 63 | 6.550 | 58.045 | 46.271 | 1.00 | 0.00 | XXXX | 3253 |
| ATOM | 3254 | CA | GLY B | 63 | 7.907 | 58.564 | 46.242 | 1.00 | 0.00 | XXXX | 3254 |
| ATOM | 3255 | C | GLY B | 63 | 8.593 | 58.246 | 44.926 | 1.00 | 0.00 | XXXX | 3255 |
| ATOM | 3256 | O | GLY B | 63 | 9.611 | 58.847 | 44.582 | 1.00 | 0.00 | XXXX | 3256 |
| ATOM | 3257 | N | ALA B | 64 | 8.024 | 57.294 | 44.192 | 1.00 | 0.00 | XXXX | 3257 |
| ATOM | 3258 | CA | ALA B | 64 | 8.425 | 57.006 | 42.816 | 1.00 | 0.00 | XXXX | 3258 |
| ATOM | 3259 | C | ALA B | 64 | 9.883 | 56.569 | 42.670 | 1.00 | 0.00 | XXXX | 3259 |
| ATOM | 3260 | O | ALA B | 64 | 10.492 | 56.785 | 41.621 | 1.00 | 0.00 | XXXX | 3260 |
| ATOM | 3261 | CB | ALA B | 64 | 8.161 | 58.223 | 41.938 | 1.00 | 0.00 | XXXX | 3261 |
| ATOM | 3262 | N | SER B | 65 | 10.434 | 55.946 | 43.709 | 1.00 | 0.00 | XXXX | 3262 |
| ATOM | 3263 | CA | SER B | 65 | 11.823 | 55.491 | 43.687 | 1.00 | 0.00 | XXXX | 3263 |
| ATOM | 3264 | C | SER B | 65 | 12.759 | 56.636 | 43.311 | 1.00 | 0.00 | XXXX | 3264 |
| ATOM | 3265 | O | SER B | 65 | 13.835 | 56.421 | 42.750 | 1.00 | 0.00 | XXXX | 3265 |
| ATOM | 3266 | CB | SER B | 65 | 11.996 | 54.327 | 42.706 | 1.00 | 0.00 | XXXX | 3266 |
| ATOM | 3267 | OG | SER B | 65 | 11.090 | 53.273 | 42.989 | 1.00 | 0.00 | XXXX | 3267 |
| ATOM | 3268 | N | ASP B | 66 | 12.340 | 57.855 | 43.631 | 1.00 | 0.00 | XXXX | 3268 |
| ATOM | 3269 | CA | ASP B | 66 | 13.077 | 59.048 | 43.239 | 1.00 | 0.00 | XXXX | 3269 |
| ATOM | 3270 | C | ASP B | 66 | 13.271 | 59.939 | 44.455 | 1.00 | 0.00 | XXXX | 3270 |
| ATOM | 3271 | O | ASP B | 66 | 12.318 | 60.503 | 44.992 | 1.00 | 0.00 | XXXX | 3271 |
| ATOM | 3272 | CB | ASP B | 66 | 12.348 | 59.799 | 42.124 | 1.00 | 0.00 | XXXX | 3272 |
| ATOM | 3273 | CG | ASP B | 66 | 13.127 | 61.001 | 41.628 | 1.00 | 0.00 | XXXX | 3273 |
| ATOM | 3274 | OD1 | ASP B | 66 | 14.143 | 60.804 | 40.927 | 1.00 | 0.00 | XXXX | 3274 |
| ATOM | 3275 | OD2 | ASP B | 66 | 12.725 | 62.141 | 41.939 | 1.00 | 0.00 | XXXX | 3275 |
| ATOM | 3276 | N | TRP B | 67 | 14.523 | 60.050 | 44.881 | 1.00 | 0.00 | XXXX | 3276 |
| ATOM | 3277 | CA | TRP B | 67 | 14.870 | 60.667 | 46.154 | 1.00 | 0.00 | XXXX | 3277 |
| ATOM | 3278 | C | TRP B | 67 | 14.465 | 62.140 | 46.230 | 1.00 | 0.00 | XXXX | 3278 |
| ATOM | 3279 | O | TRP B | 67 | 14.002 | 62.594 | 47.275 | 1.00 | 0.00 | XXXX | 3279 |
| ATOM | 3280 | CB | TRP B | 67 | 16.370 | 60.494 | 46.412 | 1.00 | 0.00 | XXXX | 3280 |
| ATOM | 3281 | CG | TRP B | 67 | 16.889 | 59.171 | 45.903 | 1.00 | 0.00 | XXXX | 3281 |
| ATOM | 3282 | CD1 | TRP B | 67 | 18.087 | 58.944 | 45.287 | 1.00 | 0.00 | XXXX | 3282 |
| ATOM | 3283 | CD2 | TRP B | 67 | 16.215 | 57.900 | 45.945 | 1.00 | 0.00 | XXXX | 3283 |
| ATOM | 3284 | NE1 | TRP B | 67 | 18.206 | 57.616 | 44.953 | 1.00 | 0.00 | XXXX | 3284 |
| ATOM | 3285 | CE2 | TRP B | 67 | 17.070 | 56.955 | 45.344 | 1.00 | 0.00 | XXXX | 3285 |
| ATOM | 3286 | CE3 | TRP B | 67 | 14.974 | 57.471 | 46.432 | 1.00 | 0.00 | XXXX | 3286 |
| ATOM | 3287 | CZ2 | TRP B | 67 | 16.725 | 55.608 | 45.221 | 1.00 | 0.00 | XXXX | 3287 |
| ATOM | 3288 | CZ3 | TRP B | 67 | 14.634 | 56.129 | 46.306 | 1.00 | 0.00 | XXXX | 3288 |
| ATOM | 3289 | CH2 | TRP B | 67 | 15.505 | 55.219 | 45.708 | 1.00 | 0.00 | XXXX | 3289 |

-continued

| | | | | | | | | | | |
|---|---|---|---|---|---|---|---|---|---|---|
| ATOM | 3290 | N | PRO B | 68 | 14.645 | 62.893 | 45.132 | 1.00 | 0.00 | XXXX | 3290 |
| ATOM | 3291 | CA | PRO B | 68 | 14.133 | 64.268 | 45.108 | 1.00 | 0.00 | XXXX | 3291 |
| ATOM | 3292 | C | PRO B | 68 | 12.615 | 64.321 | 45.289 | 1.00 | 0.00 | XXXX | 3292 |
| ATOM | 3293 | O | PRO B | 68 | 12.105 | 65.221 | 45.958 | 1.00 | 0.00 | XXXX | 3293 |
| ATOM | 3294 | CB | PRO B | 68 | 14.536 | 64.765 | 43.719 | 1.00 | 0.00 | XXXX | 3294 |
| ATOM | 3295 | CG | PRO B | 68 | 15.733 | 63.952 | 43.369 | 1.00 | 0.00 | XXXX | 3295 |
| ATOM | 3296 | CD | PRO B | 68 | 15.457 | 62.591 | 43.940 | 1.00 | 0.00 | XXXX | 3296 |
| ATOM | 3297 | N | THR B | 69 | 11.909 | 63.363 | 44.695 | 1.00 | 0.00 | XXXX | 3297 |
| ATOM | 3298 | CA | THR B | 69 | 10.462 | 63.263 | 44.855 | 1.00 | 0.00 | XXXX | 3298 |
| ATOM | 3299 | C | THR B | 69 | 10.078 | 62.969 | 46.300 | 1.00 | 0.00 | XXXX | 3299 |
| ATOM | 3300 | O | THR B | 69 | 9.096 | 63.507 | 46.809 | 1.00 | 0.00 | XXXX | 3300 |
| ATOM | 3301 | CB | THR B | 69 | 9.871 | 62.171 | 43.949 | 1.00 | 0.00 | XXXX | 3301 |
| ATOM | 3302 | OG1 | THR B | 69 | 10.154 | 62.485 | 42.579 | 1.00 | 0.00 | XXXX | 3302 |
| ATOM | 3303 | CG2 | THR B | 69 | 8.363 | 62.075 | 44.144 | 1.00 | 0.00 | XXXX | 3303 |
| ATOM | 3304 | N | PHE B | 70 | 10.851 | 62.104 | 46.952 | 1.00 | 0.00 | XXXX | 3304 |
| ATOM | 3305 | CA | PHE B | 70 | 10.633 | 61.796 | 48.362 | 1.00 | 0.00 | XXXX | 3305 |
| ATOM | 3306 | C | PHE B | 70 | 10.716 | 63.062 | 49.208 | 1.00 | 0.00 | XXXX | 3306 |
| ATOM | 3307 | O | PHE B | 70 | 9.897 | 63.278 | 50.101 | 1.00 | 0.00 | XXXX | 3307 |
| ATOM | 3308 | CB | PHE B | 70 | 11.651 | 60.764 | 48.859 | 1.00 | 0.00 | XXXX | 3308 |
| ATOM | 3309 | CG | PHE B | 70 | 11.194 | 59.339 | 48.717 | 1.00 | 0.00 | XXXX | 3309 |
| ATOM | 3310 | CD1 | PHE B | 70 | 10.453 | 58.732 | 49.719 | 1.00 | 0.00 | XXXX | 3310 |
| ATOM | 3311 | CD2 | PHE B | 70 | 11.513 | 58.603 | 47.588 | 1.00 | 0.00 | XXXX | 3311 |
| ATOM | 3312 | CE1 | PHE B | 70 | 10.034 | 57.421 | 49.594 | 1.00 | 0.00 | XXXX | 3312 |
| ATOM | 3313 | CE2 | PHE B | 70 | 11.096 | 57.291 | 47.458 | 1.00 | 0.00 | XXXX | 3313 |
| ATOM | 3314 | CZ | PHE B | 70 | 10.356 | 56.699 | 48.462 | 1.00 | 0.00 | XXXX | 3314 |
| ATOM | 3315 | N | ALA B | 71 | 11.714 | 63.893 | 48.919 | 1.00 | 0.00 | XXXX | 3315 |
| ATOM | 3316 | CA | ALA B | 71 | 11.921 | 65.141 | 49.646 | 1.00 | 0.00 | XXXX | 3316 |
| ATOM | 3317 | C | ALA B | 71 | 10.749 | 66.100 | 49.451 | 1.00 | 0.00 | XXXX | 3317 |
| ATOM | 3318 | O | ALA B | 71 | 10.236 | 66.669 | 50.416 | 1.00 | 0.00 | XXXX | 3318 |
| ATOM | 3319 | CB | ALA B | 71 | 13.224 | 65.802 | 49.210 | 1.00 | 0.00 | XXXX | 3319 |
| ATOM | 3320 | N | GLU B | 72 | 10.335 | 66.281 | 48.200 | 1.00 | 0.00 | XXXX | 3320 |
| ATOM | 3321 | CA | GLU B | 72 | 9.223 | 67.172 | 47.881 | 1.00 | 0.00 | XXXX | 3321 |
| ATOM | 3322 | C | GLU B | 72 | 7.914 | 66.696 | 48.502 | 1.00 | 0.00 | XXXX | 3322 |
| ATOM | 3323 | O | GLU B | 72 | 7.141 | 67.497 | 49.025 | 1.00 | 0.00 | XXXX | 3323 |
| ATOM | 3324 | CB | GLU B | 72 | 9.064 | 67.313 | 46.366 | 1.00 | 0.00 | XXXX | 3324 |
| ATOM | 3325 | CG | GLU B | 72 | 10.132 | 68.172 | 45.709 | 1.00 | 0.00 | XXXX | 3325 |
| ATOM | 3326 | CD | GLU B | 72 | 10.236 | 69.549 | 46.342 | 1.00 | 0.00 | XXXX | 3326 |
| ATOM | 3327 | OE1 | GLU B | 72 | 9.200 | 70.240 | 46.441 | 1.00 | 0.00 | XXXX | 3327 |
| ATOM | 3328 | OE2 | GLU B | 72 | 11.356 | 69.944 | 46.737 | 1.00 | 0.00 | XXXX | 3328 |
| ATOM | 3329 | N | LYS B | 73 | 7.671 | 65.392 | 48.443 | 1.00 | 0.00 | XXXX | 3329 |
| ATOM | 3330 | CA | LYS B | 73 | 6.466 | 64.815 | 49.028 | 1.00 | 0.00 | XXXX | 3330 |
| ATOM | 3331 | C | LYS B | 73 | 6.451 | 64.986 | 50.543 | 1.00 | 0.00 | XXXX | 3331 |
| ATOM | 3332 | O | LYS B | 73 | 5.409 | 65.269 | 51.133 | 1.00 | 0.00 | XXXX | 3332 |
| ATOM | 3333 | CB | LYS B | 73 | 6.351 | 63.334 | 48.666 | 1.00 | 0.00 | XXXX | 3333 |
| ATOM | 3334 | CG | LYS B | 73 | 6.074 | 63.069 | 47.197 | 1.00 | 0.00 | XXXX | 3334 |
| ATOM | 3335 | CD | LYS B | 73 | 4.739 | 63.663 | 46.781 | 1.00 | 0.00 | XXXX | 3335 |
| ATOM | 3336 | CE | LYS B | 73 | 4.412 | 63.336 | 45.333 | 1.00 | 0.00 | XXXX | 3336 |
| ATOM | 3337 | NZ | LYS B | 73 | 3.068 | 63.847 | 44.941 | 1.00 | 0.00 | XXXX | 3337 |
| ATOM | 3338 | N | ALA B | 74 | 7.610 | 64.810 | 51.167 | 1.00 | 0.00 | XXXX | 3338 |
| ATOM | 3339 | CA | ALA B | 74 | 7.730 | 64.985 | 52.609 | 1.00 | 0.00 | XXXX | 3339 |
| ATOM | 3340 | C | ALA B | 74 | 7.413 | 66.425 | 52.998 | 1.00 | 0.00 | XXXX | 3340 |
| ATOM | 3341 | O | ALA B | 74 | 6.761 | 66.676 | 54.011 | 1.00 | 0.00 | XXXX | 3341 |
| ATOM | 3342 | CB | ALA B | 74 | 9.121 | 64.597 | 53.081 | 1.00 | 0.00 | XXXX | 3342 |
| ATOM | 3343 | N | LYS B | 75 | 7.880 | 67.366 | 52.182 | 1.00 | 0.00 | XXXX | 3343 |
| ATOM | 3344 | CA | LYS B | 75 | 7.631 | 68.784 | 52.415 | 1.00 | 0.00 | XXXX | 3344 |
| ATOM | 3345 | C | LYS B | 75 | 6.141 | 69.105 | 52.307 | 1.00 | 0.00 | XXXX | 3345 |
| ATOM | 3346 | O | LYS B | 75 | 5.587 | 69.805 | 53.155 | 1.00 | 0.00 | XXXX | 3346 |
| ATOM | 3347 | CB | LYS B | 75 | 8.431 | 69.639 | 51.430 | 1.00 | 0.00 | XXXX | 3347 |
| ATOM | 3348 | CG | LYS B | 75 | 8.344 | 71.133 | 51.703 | 1.00 | 0.00 | XXXX | 3348 |
| ATOM | 3349 | CD | LYS B | 75 | 9.277 | 71.924 | 50.801 | 1.00 | 0.00 | XXXX | 3349 |
| ATOM | 3350 | CE | LYS B | 75 | 9.225 | 73.409 | 51.124 | 1.00 | 0.00 | XXXX | 3350 |
| ATOM | 3351 | NZ | LYS B | 75 | 10.160 | 74.198 | 50.274 | 1.00 | 0.00 | XXXX | 3351 |
| ATOM | 3352 | N | LYS B | 76 | 5.502 | 68.593 | 51.260 | 1.00 | 0.00 | XXXX | 3352 |
| ATOM | 3353 | CA | LYS B | 76 | 4.065 | 68.774 | 51.069 | 1.00 | 0.00 | XXXX | 3353 |
| ATOM | 3354 | C | LYS B | 76 | 3.255 | 68.183 | 52.221 | 1.00 | 0.00 | XXXX | 3354 |
| ATOM | 3355 | O | LYS B | 76 | 2.336 | 68.823 | 52.734 | 1.00 | 0.00 | XXXX | 3355 |
| ATOM | 3356 | CB | LYS B | 76 | 3.617 | 68.144 | 49.749 | 1.00 | 0.00 | XXXX | 3356 |
| ATOM | 3357 | CG | LYS B | 76 | 2.107 | 68.044 | 49.600 | 1.00 | 0.00 | XXXX | 3357 |
| ATOM | 3358 | CD | LYS B | 76 | 1.717 | 67.390 | 48.286 | 1.00 | 0.00 | XXXX | 3358 |
| ATOM | 3359 | CE | LYS B | 76 | 1.038 | 66.050 | 48.516 | 1.00 | 0.00 | XXXX | 3359 |
| ATOM | 3360 | NZ | LYS B | 76 | −0.234 | 66.188 | 49.280 | 1.00 | 0.00 | XXXX | 3360 |
| ATOM | 3361 | N | LEU B | 77 | 3.601 | 66.964 | 52.622 | 1.00 | 0.00 | XXXX | 3361 |
| ATOM | 3362 | CA | LEU B | 77 | 2.886 | 66.272 | 53.692 | 1.00 | 0.00 | XXXX | 3362 |
| ATOM | 3363 | C | LEU B | 77 | 2.960 | 67.031 | 55.013 | 1.00 | 0.00 | XXXX | 3363 |
| ATOM | 3364 | O | LEU B | 77 | 1.988 | 67.080 | 55.766 | 1.00 | 0.00 | XXXX | 3364 |
| ATOM | 3365 | CB | LEU B | 77 | 3.437 | 64.856 | 53.874 | 1.00 | 0.00 | XXXX | 3365 |
| ATOM | 3366 | CG | LEU B | 77 | 2.976 | 63.820 | 52.847 | 1.00 | 0.00 | XXXX | 3366 |
| ATOM | 3367 | CD1 | LEU B | 77 | 3.788 | 62.538 | 52.970 | 1.00 | 0.00 | XXXX | 3367 |
| ATOM | 3368 | CD2 | LEU B | 77 | 1.486 | 63.538 | 53.004 | 1.00 | 0.00 | XXXX | 3368 |

-continued

| | | | | | | | | | | |
|---|---|---|---|---|---|---|---|---|---|---|
| ATOM | 3369 | N | LEU B | 78 | 4.117 | 67.623 | 55.291 | 1.00 | 0.00 | XXXX | 3369 |
| ATOM | 3370 | CA | LEU B | 78 | 4.315 | 68.343 | 56.543 | 1.00 | 0.00 | XXXX | 3370 |
| ATOM | 3371 | C | LEU B | 78 | 3.735 | 69.754 | 56.501 | 1.00 | 0.00 | XXXX | 3371 |
| ATOM | 3372 | O | LEU B | 78 | 3.113 | 70.206 | 57.463 | 1.00 | 0.00 | XXXX | 3372 |
| ATOM | 3373 | CB | LEU B | 78 | 5.805 | 68.412 | 56.886 | 1.00 | 0.00 | XXXX | 3373 |
| ATOM | 3374 | CG | LEU B | 78 | 6.503 | 67.091 | 57.218 | 1.00 | 0.00 | XXXX | 3374 |
| ATOM | 3375 | CD1 | LEU B | 78 | 7.990 | 67.315 | 57.447 | 1.00 | 0.00 | XXXX | 3375 |
| ATOM | 3376 | CD2 | LEU B | 78 | 5.863 | 66.433 | 58.431 | 1.00 | 0.00 | XXXX | 3376 |
| ATOM | 3377 | N | GLN B | 79 | 3.941 | 70.449 | 55.388 | 1.00 | 0.00 | XXXX | 3377 |
| ATOM | 3378 | CA | GLN B | 79 | 3.589 | 71.863 | 55.299 | 1.00 | 0.00 | XXXX | 3378 |
| ATOM | 3379 | C | GLN B | 79 | 2.191 | 72.129 | 54.738 | 1.00 | 0.00 | XXXX | 3379 |
| ATOM | 3380 | O | GLN B | 79 | 1.518 | 73.063 | 55.171 | 1.00 | 0.00 | XXXX | 3380 |
| ATOM | 3381 | CB | GLN B | 79 | 4.636 | 72.605 | 54.464 | 1.00 | 0.00 | XXXX | 3381 |
| ATOM | 3382 | CG | GLN B | 79 | 6.012 | 72.632 | 55.113 | 1.00 | 0.00 | XXXX | 3382 |
| ATOM | 3383 | CD | GLN B | 79 | 7.008 | 73.483 | 54.353 | 1.00 | 0.00 | XXXX | 3383 |
| ATOM | 3384 | OE1 | GLN B | 79 | 6.693 | 74.041 | 53.303 | 1.00 | 0.00 | XXXX | 3384 |
| ATOM | 3385 | NE2 | GLN B | 79 | 8.220 | 73.592 | 54.886 | 1.00 | 0.00 | XXXX | 3385 |
| ATOM | 3386 | N | LYS B | 80 | 1.754 | 71.319 | 53.778 | 1.00 | 0.00 | XXXX | 3386 |
| ATOM | 3387 | CA | LYS B | 80 | 0.447 | 71.532 | 53.162 | 1.00 | 0.00 | XXXX | 3387 |
| ATOM | 3388 | C | LYS B | 80 | −0.640 | 70.662 | 53.785 | 1.00 | 0.00 | XXXX | 3388 |
| ATOM | 3389 | O | LYS B | 80 | −1.696 | 71.162 | 54.174 | 1.00 | 0.00 | XXXX | 3389 |
| ATOM | 3390 | CB | LYS B | 80 | 0.515 | 71.274 | 51.655 | 1.00 | 0.00 | XXXX | 3390 |
| ATOM | 3391 | CG | LYS B | 80 | 1.393 | 72.255 | 50.897 | 1.00 | 0.00 | XXXX | 3391 |
| ATOM | 3392 | CD | LYS B | 80 | 0.822 | 73.663 | 50.963 | 1.00 | 0.00 | XXXX | 3392 |
| ATOM | 3393 | CE | LYS B | 80 | 1.635 | 74.636 | 50.124 | 1.00 | 0.00 | XXXX | 3393 |
| ATOM | 3394 | NZ | LYS B | 80 | 1.642 | 74.260 | 48.682 | 1.00 | 0.00 | XXXX | 3394 |
| ATOM | 3395 | N | ASP B | 81 | −0.382 | 69.362 | 53.880 | 1.00 | 0.00 | XXXX | 3395 |
| ATOM | 3396 | CA | ASP B | 81 | −1.349 | 68.441 | 54.463 | 1.00 | 0.00 | XXXX | 3396 |
| ATOM | 3397 | C | ASP B | 81 | −1.303 | 68.521 | 55.983 | 1.00 | 0.00 | XXXX | 3397 |
| ATOM | 3398 | O | ASP B | 81 | −2.265 | 68.167 | 56.666 | 1.00 | 0.00 | XXXX | 3398 |
| ATOM | 3399 | CB | ASP B | 81 | −1.084 | 67.009 | 53.994 | 1.00 | 0.00 | XXXX | 3399 |
| ATOM | 3400 | CG | ASP B | 81 | −1.237 | 66.851 | 52.494 | 1.00 | 0.00 | XXXX | 3400 |
| ATOM | 3401 | OD1 | ASP B | 81 | −2.301 | 67.228 | 51.960 | 1.00 | 0.00 | XXXX | 3401 |
| ATOM | 3402 | OD2 | ASP B | 81 | −0.293 | 66.348 | 51.849 | 1.00 | 0.00 | XXXX | 3402 |
| ATOM | 3403 | N | LYS B | 82 | −0.175 | 69.002 | 56.498 | 1.00 | 0.00 | XXXX | 3403 |
| ATOM | 3404 | CA | LYS B | 82 | 0.039 | 69.157 | 57.933 | 1.00 | 0.00 | XXXX | 3404 |
| ATOM | 3405 | C | LYS B | 82 | −0.203 | 67.865 | 58.708 | 1.00 | 0.00 | XXXX | 3405 |
| ATOM | 3406 | O | LYS B | 82 | −0.942 | 67.849 | 59.691 | 1.00 | 0.00 | XXXX | 3406 |
| ATOM | 3407 | CB | LYS B | 82 | −0.855 | 70.272 | 58.478 | 1.00 | 0.00 | XXXX | 3407 |
| ATOM | 3408 | CG | LYS B | 82 | −0.507 | 71.648 | 57.932 | 1.00 | 0.00 | XXXX | 3408 |
| ATOM | 3409 | CD | LYS B | 82 | −1.493 | 72.702 | 58.405 | 1.00 | 0.00 | XXXX | 3409 |
| ATOM | 3410 | CE | LYS B | 82 | −1.203 | 74.048 | 57.762 | 1.00 | 0.00 | XXXX | 3410 |
| ATOM | 3411 | NZ | LYS B | 82 | 0.231 | 74.429 | 57.894 | 1.00 | 0.00 | XXXX | 3411 |
| ATOM | 3412 | N | VAL B | 83 | 0.422 | 66.783 | 58.255 | 1.00 | 0.00 | XXXX | 3412 |
| ATOM | 3413 | CA | VAL B | 83 | 0.317 | 65.499 | 58.936 | 1.00 | 0.00 | XXXX | 3413 |
| ATOM | 3414 | C | VAL B | 83 | 1.063 | 65.539 | 60.265 | 1.00 | 0.00 | XXXX | 3414 |
| ATOM | 3415 | O | VAL B | 83 | 1.942 | 66.377 | 60.466 | 1.00 | 0.00 | XXXX | 3415 |
| ATOM | 3416 | CB | VAL B | 83 | 0.875 | 64.350 | 58.074 | 1.00 | 0.00 | XXXX | 3416 |
| ATOM | 3417 | CG1 | VAL B | 83 | 0.137 | 64.279 | 56.741 | 1.00 | 0.00 | XXXX | 3417 |
| ATOM | 3418 | CG2 | VAL B | 83 | 2.372 | 64.525 | 57.856 | 1.00 | 0.00 | XXXX | 3418 |
| ATOM | 3419 | N | ALA B | 84 | 0.711 | 64.632 | 61.171 | 1.00 | 0.00 | XXXX | 3419 |
| ATOM | 3420 | CA | ALA B | 84 | 1.361 | 64.567 | 62.476 | 1.00 | 0.00 | XXXX | 3420 |
| ATOM | 3421 | C | ALA B | 84 | 2.642 | 63.748 | 62.403 | 1.00 | 0.00 | XXXX | 3421 |
| ATOM | 3422 | O | ALA B | 84 | 3.512 | 63.858 | 63.267 | 1.00 | 0.00 | XXXX | 3422 |
| ATOM | 3423 | CB | ALA B | 84 | 0.417 | 63.979 | 63.512 | 1.00 | 0.00 | XXXX | 3423 |
| ATOM | 3424 | N | VAL B | 85 | 2.748 | 62.924 | 61.367 | 1.00 | 0.00 | XXXX | 3424 |
| ATOM | 3425 | CA | VAL B | 85 | 3.866 | 62.002 | 61.225 | 1.00 | 0.00 | XXXX | 3425 |
| ATOM | 3426 | C | VAL B | 85 | 3.896 | 61.422 | 59.817 | 1.00 | 0.00 | XXXX | 3426 |
| ATOM | 3427 | O | VAL B | 85 | 2.869 | 61.357 | 59.143 | 1.00 | 0.00 | XXXX | 3427 |
| ATOM | 3428 | CB | VAL B | 85 | 3.785 | 60.849 | 62.249 | 1.00 | 0.00 | XXXX | 3428 |
| ATOM | 3429 | CG1 | VAL B | 85 | 2.531 | 60.021 | 62.018 | 1.00 | 0.00 | XXXX | 3429 |
| ATOM | 3430 | CG2 | VAL B | 85 | 5.024 | 59.971 | 62.168 | 1.00 | 0.00 | XXXX | 3430 |
| ATOM | 3431 | N | ILE B | 86 | 5.077 | 61.009 | 59.374 | 1.00 | 0.00 | XXXX | 3431 |
| ATOM | 3432 | CA | ILE B | 86 | 5.208 | 60.329 | 58.096 | 1.00 | 0.00 | XXXX | 3432 |
| ATOM | 3433 | C | ILE B | 86 | 5.740 | 58.914 | 58.282 | 1.00 | 0.00 | XXXX | 3433 |
| ATOM | 3434 | O | ILE B | 86 | 6.769 | 58.705 | 58.923 | 1.00 | 0.00 | XXXX | 3434 |
| ATOM | 3435 | CB | ILE B | 86 | 6.144 | 61.090 | 57.137 | 1.00 | 0.00 | XXXX | 3435 |
| ATOM | 3436 | CG1 | ILE B | 86 | 5.607 | 62.497 | 56.864 | 1.00 | 0.00 | XXXX | 3436 |
| ATOM | 3437 | CD1 | ILE B | 86 | 6.550 | 63.359 | 56.051 | 1.00 | 0.00 | XXXX | 3437 |
| ATOM | 3438 | CG2 | ILE B | 86 | 6.320 | 60.318 | 55.835 | 1.00 | 0.00 | XXXX | 3438 |
| ATOM | 3439 | N | PHE B | 87 | 5.023 | 57.944 | 57.726 | 1.00 | 0.00 | XXXX | 3439 |
| ATOM | 3440 | CA | PHE B | 87 | 5.529 | 56.582 | 57.631 | 1.00 | 0.00 | XXXX | 3440 |
| ATOM | 3441 | C | PHE B | 87 | 6.019 | 56.349 | 56.208 | 1.00 | 0.00 | XXXX | 3441 |
| ATOM | 3442 | O | PHE B | 87 | 5.255 | 56.511 | 55.257 | 1.00 | 0.00 | XXXX | 3442 |
| ATOM | 3443 | CB | PHE B | 87 | 4.446 | 55.565 | 58.000 | 1.00 | 0.00 | XXXX | 3443 |
| ATOM | 3444 | CG | PHE B | 87 | 3.816 | 55.806 | 59.345 | 1.00 | 0.00 | XXXX | 3444 |
| ATOM | 3445 | CD1 | PHE B | 87 | 4.454 | 55.403 | 60.506 | 1.00 | 0.00 | XXXX | 3445 |
| ATOM | 3446 | CD2 | PHE B | 87 | 2.582 | 56.427 | 59.446 | 1.00 | 0.00 | XXXX | 3446 |
| ATOM | 3447 | CE1 | PHE B | 87 | 3.876 | 55.621 | 61.745 | 1.00 | 0.00 | XXXX | 3447 |

-continued

| | | | | | | | | | | |
|---|---|---|---|---|---|---|---|---|---|---|
| ATOM | 3448 | CE2 | PHE B | 87 | 1.998 | 56.649 | 60.680 | 1.00 | 0.00 | XXXX | 3448 |
| ATOM | 3449 | CZ | PHE B | 87 | 2.647 | 56.245 | 61.831 | 1.00 | 0.00 | XXXX | 3449 |
| ATOM | 3450 | N | GLY B | 88 | 7.284 | 55.974 | 56.047 | 1.00 | 0.00 | XXXX | 3450 |
| ATOM | 3451 | CA | GLY B | 88 | 7.797 | 55.751 | 54.709 | 1.00 | 0.00 | XXXX | 3451 |
| ATOM | 3452 | C | GLY B | 88 | 9.300 | 55.660 | 54.543 | 1.00 | 0.00 | XXXX | 3452 |
| ATOM | 3453 | O | GLY B | 88 | 10.046 | 55.559 | 55.519 | 1.00 | 0.00 | XXXX | 3453 |
| ATOM | 3454 | N | ALA B | 89 | 9.719 | 55.692 | 53.279 | 1.00 | 0.00 | XXXX | 3454 |
| ATOM | 3455 | CA | ALA B | 89 | 11.110 | 55.541 | 52.853 | 1.00 | 0.00 | XXXX | 3455 |
| ATOM | 3456 | C | ALA B | 89 | 11.555 | 54.082 | 52.927 | 1.00 | 0.00 | XXXX | 3456 |
| ATOM | 3457 | O | ALA B | 89 | 10.989 | 53.282 | 53.671 | 1.00 | 0.00 | XXXX | 3457 |
| ATOM | 3458 | CB | ALA B | 89 | 12.037 | 56.428 | 53.684 | 1.00 | 0.00 | XXXX | 3458 |
| ATOM | 3459 | N | TRP B | 90 | 12.572 | 53.749 | 52.138 | 1.00 | 0.00 | XXXX | 3459 |
| ATOM | 3460 | CA | TRP B | 90 | 13.183 | 52.425 | 52.160 | 1.00 | 0.00 | XXXX | 3460 |
| ATOM | 3461 | C | TRP B | 90 | 14.684 | 52.580 | 51.972 | 1.00 | 0.00 | XXXX | 3461 |
| ATOM | 3462 | O | TRP B | 90 | 15.461 | 52.312 | 52.886 | 1.00 | 0.00 | XXXX | 3462 |
| ATOM | 3463 | CB | TRP B | 90 | 12.588 | 51.518 | 51.076 | 1.00 | 0.00 | XXXX | 3463 |
| ATOM | 3464 | CG | TRP B | 90 | 13.260 | 50.167 | 50.957 | 1.00 | 0.00 | XXXX | 3464 |
| ATOM | 3465 | CD1 | TRP B | 90 | 14.537 | 49.916 | 50.534 | 1.00 | 0.00 | XXXX | 3465 |
| ATOM | 3466 | CD2 | TRP B | 90 | 12.682 | 48.888 | 51.253 | 1.00 | 0.00 | XXXX | 3466 |
| ATOM | 3467 | NE1 | TRP B | 90 | 14.789 | 48.567 | 50.555 | 1.00 | 0.00 | XXXX | 3467 |
| ATOM | 3468 | CE2 | TRP B | 90 | 13.668 | 47.913 | 50.990 | 1.00 | 0.00 | XXXX | 3468 |
| ATOM | 3469 | CE3 | TRP B | 90 | 11.429 | 48.472 | 51.714 | 1.00 | 0.00 | XXXX | 3469 |
| ATOM | 3470 | CZ2 | TRP B | 90 | 13.440 | 46.551 | 51.177 | 1.00 | 0.00 | XXXX | 3470 |
| ATOM | 3471 | CZ3 | TRP B | 90 | 11.204 | 47.119 | 51.898 | 1.00 | 0.00 | XXXX | 3471 |
| ATOM | 3472 | CH2 | TRP B | 90 | 12.205 | 46.175 | 51.629 | 1.00 | 0.00 | XXXX | 3472 |
| ATOM | 3473 | N | THR B | 91 | 15.087 | 53.005 | 50.778 | 1.00 | 0.00 | XXXX | 3473 |
| ATOM | 3474 | CA | THR B | 91 | 16.499 | 53.226 | 50.498 | 1.00 | 0.00 | XXXX | 3474 |
| ATOM | 3475 | C | THR B | 91 | 17.026 | 54.335 | 51.399 | 1.00 | 0.00 | XXXX | 3475 |
| ATOM | 3476 | O | THR B | 91 | 16.305 | 55.280 | 51.716 | 1.00 | 0.00 | XXXX | 3476 |
| ATOM | 3477 | CB | THR B | 91 | 16.747 | 53.606 | 49.023 | 1.00 | 0.00 | XXXX | 3477 |
| ATOM | 3478 | OG1 | THR B | 91 | 16.165 | 54.886 | 48.750 | 1.00 | 0.00 | XXXX | 3478 |
| ATOM | 3479 | CG2 | THR B | 91 | 16.149 | 52.563 | 48.087 | 1.00 | 0.00 | XXXX | 3479 |
| ATOM | 3480 | N | SER B | 92 | 18.281 | 54.217 | 51.816 | 1.00 | 0.00 | XXXX | 3480 |
| ATOM | 3481 | CA | SER B | 92 | 18.903 | 55.246 | 52.637 | 1.00 | 0.00 | XXXX | 3481 |
| ATOM | 3482 | C | SER B | 92 | 19.003 | 56.551 | 51.857 | 1.00 | 0.00 | XXXX | 3482 |
| ATOM | 3483 | O | SER B | 92 | 19.082 | 57.632 | 52.442 | 1.00 | 0.00 | XXXX | 3483 |
| ATOM | 3484 | CB | SER B | 92 | 20.282 | 54.794 | 53.116 | 1.00 | 0.00 | XXXX | 3484 |
| ATOM | 3485 | OG | SER B | 92 | 20.167 | 53.702 | 54.012 | 1.00 | 0.00 | XXXX | 3485 |
| ATOM | 3486 | N | ALA B | 93 | 18.993 | 56.442 | 50.533 | 1.00 | 0.00 | XXXX | 3486 |
| ATOM | 3487 | CA | ALA B | 93 | 18.954 | 57.614 | 49.669 | 1.00 | 0.00 | XXXX | 3487 |
| ATOM | 3488 | C | ALA B | 93 | 17.653 | 58.377 | 49.888 | 1.00 | 0.00 | XXXX | 3488 |
| ATOM | 3489 | O | ALA B | 93 | 17.651 | 59.600 | 50.026 | 1.00 | 0.00 | XXXX | 3489 |
| ATOM | 3490 | CB | ALA B | 93 | 19.099 | 57.208 | 48.211 | 1.00 | 0.00 | XXXX | 3490 |
| ATOM | 3491 | N | SER B | 94 | 16.547 | 57.643 | 49.925 | 1.00 | 0.00 | XXXX | 3491 |
| ATOM | 3492 | CA | SER B | 94 | 15.245 | 58.249 | 50.158 | 1.00 | 0.00 | XXXX | 3492 |
| ATOM | 3493 | C | SER B | 94 | 15.138 | 58.768 | 51.589 | 1.00 | 0.00 | XXXX | 3493 |
| ATOM | 3494 | O | SER B | 94 | 14.581 | 59.840 | 51.825 | 1.00 | 0.00 | XXXX | 3494 |
| ATOM | 3495 | CB | SER B | 94 | 14.124 | 57.247 | 49.871 | 1.00 | 0.00 | XXXX | 3495 |
| ATOM | 3496 | OG | SER B | 94 | 14.126 | 56.191 | 50.816 | 1.00 | 0.00 | XXXX | 3496 |
| ATOM | 3497 | N | ARG B | 95 | 15.673 | 58.010 | 52.543 | 1.00 | 0.00 | XXXX | 3497 |
| ATOM | 3498 | CA | ARG B | 95 | 15.622 | 58.420 | 53.943 | 1.00 | 0.00 | XXXX | 3498 |
| ATOM | 3499 | C | ARG B | 95 | 16.429 | 59.694 | 54.165 | 1.00 | 0.00 | XXXX | 3499 |
| ATOM | 3500 | O | ARG B | 95 | 15.975 | 60.615 | 54.842 | 1.00 | 0.00 | XXXX | 3500 |
| ATOM | 3501 | CB | ARG B | 95 | 16.136 | 57.314 | 54.870 | 1.00 | 0.00 | XXXX | 3501 |
| ATOM | 3502 | CG | ARG B | 95 | 15.871 | 57.604 | 56.346 | 1.00 | 0.00 | XXXX | 3502 |
| ATOM | 3503 | CD | ARG B | 95 | 16.634 | 56.679 | 57.287 | 1.00 | 0.00 | XXXX | 3503 |
| ATOM | 3504 | NE | ARG B | 95 | 18.081 | 56.863 | 57.196 | 1.00 | 0.00 | XXXX | 3504 |
| ATOM | 3505 | CZ | ARG B | 95 | 18.902 | 56.047 | 56.542 | 1.00 | 0.00 | XXXX | 3505 |
| ATOM | 3506 | NH1 | ARG B | 95 | 18.423 | 54.974 | 55.928 | 1.00 | 0.00 | XXXX | 3506 |
| ATOM | 3507 | NH2 | ARG B | 95 | 20.203 | 56.298 | 56.512 | 1.00 | 0.00 | XXXX | 3507 |
| ATOM | 3508 | N | LYS B | 96 | 17.627 | 59.740 | 53.588 | 1.00 | 0.00 | XXXX | 3508 |
| ATOM | 3509 | CA | LYS B | 96 | 18.511 | 60.887 | 53.761 | 1.00 | 0.00 | XXXX | 3509 |
| ATOM | 3510 | C | LYS B | 96 | 18.011 | 62.113 | 53.003 | 1.00 | 0.00 | XXXX | 3510 |
| ATOM | 3511 | O | LYS B | 96 | 18.399 | 63.239 | 53.314 | 1.00 | 0.00 | XXXX | 3511 |
| ATOM | 3512 | CB | LYS B | 96 | 19.938 | 60.539 | 53.330 | 1.00 | 0.00 | XXXX | 3512 |
| ATOM | 3513 | CG | LYS B | 96 | 20.702 | 59.740 | 54.374 | 1.00 | 0.00 | XXXX | 3513 |
| ATOM | 3514 | CD | LYS B | 96 | 22.131 | 59.468 | 53.946 | 1.00 | 0.00 | XXXX | 3514 |
| ATOM | 3515 | CE | LYS B | 96 | 22.839 | 58.579 | 54.956 | 1.00 | 0.00 | XXXX | 3515 |
| ATOM | 3516 | NZ | LYS B | 96 | 22.991 | 59.251 | 56.278 | 1.00 | 0.00 | XXXX | 3516 |
| ATOM | 3517 | N | ALA B | 97 | 17.159 | 61.895 | 52.006 | 1.00 | 0.00 | XXXX | 3517 |
| ATOM | 3518 | CA | ALA B | 97 | 16.509 | 63.002 | 51.312 | 1.00 | 0.00 | XXXX | 3518 |
| ATOM | 3519 | C | ALA B | 97 | 15.403 | 63.608 | 52.175 | 1.00 | 0.00 | XXXX | 3519 |
| ATOM | 3520 | O | ALA B | 97 | 15.170 | 64.816 | 52.147 | 1.00 | 0.00 | XXXX | 3520 |
| ATOM | 3521 | CB | ALA B | 97 | 15.945 | 62.538 | 49.976 | 1.00 | 0.00 | XXXX | 3521 |
| ATOM | 3522 | N | VAL B | 98 | 14.732 | 62.758 | 52.946 | 1.00 | 0.00 | XXXX | 3522 |
| ATOM | 3523 | CA | VAL B | 98 | 13.649 | 63.190 | 53.825 | 1.00 | 0.00 | XXXX | 3523 |
| ATOM | 3524 | C | VAL B | 98 | 14.186 | 63.793 | 55.123 | 1.00 | 0.00 | XXXX | 3524 |
| ATOM | 3525 | O | VAL B | 98 | 13.556 | 64.667 | 55.721 | 1.00 | 0.00 | XXXX | 3525 |
| ATOM | 3526 | CB | VAL B | 98 | 12.704 | 62.018 | 54.164 | 1.00 | 0.00 | XXXX | 3526 |

-continued

| | | | | | | | | | | |
|---|---|---|---|---|---|---|---|---|---|---|
| ATOM | 3527 | CG1 | VAL B | 98 | 11.710 | 62.420 | 55.245 | 1.00 | 0.00 XXXX | 3527 |
| ATOM | 3528 | CG2 | VAL B | 98 | 11.978 | 61.544 | 52.913 | 1.00 | 0.00 XXXX | 3528 |
| ATOM | 3529 | N | LEU B | 99 | 15.355 | 63.319 | 55.543 | 1.00 | 0.00 XXXX | 3529 |
| ATOM | 3530 | CA | LEU B | 99 | 15.948 | 63.693 | 56.826 | 1.00 | 0.00 XXXX | 3530 |
| ATOM | 3531 | C | LEU B | 99 | 16.012 | 65.204 | 57.054 | 1.00 | 0.00 XXXX | 3531 |
| ATOM | 3532 | O | LEU B | 99 | 15.560 | 65.693 | 58.089 | 1.00 | 0.00 XXXX | 3532 |
| ATOM | 3533 | CB | LEU B | 99 | 17.352 | 63.087 | 56.943 | 1.00 | 0.00 XXXX | 3533 |
| ATOM | 3534 | CG | LEU B | 99 | 18.123 | 63.280 | 58.252 | 1.00 | 0.00 XXXX | 3534 |
| ATOM | 3535 | CD1 | LEU B | 99 | 19.194 | 62.210 | 58.392 | 1.00 | 0.00 XXXX | 3535 |
| ATOM | 3536 | CD2 | LEU B | 99 | 18.753 | 64.664 | 58.317 | 1.00 | 0.00 XXXX | 3536 |
| ATOM | 3537 | N | PRO B | 100 | 16.576 | 65.951 | 56.091 | 1.00 | 0.00 XXXX | 3537 |
| ATOM | 3538 | CA | PRO B | 100 | 16.666 | 67.405 | 56.256 | 1.00 | 0.00 XXXX | 3538 |
| ATOM | 3539 | C | PRO B | 100 | 15.292 | 68.071 | 56.305 | 1.00 | 0.00 XXXX | 3539 |
| ATOM | 3540 | O | PRO B | 100 | 15.140 | 69.120 | 56.931 | 1.00 | 0.00 XXXX | 3540 |
| ATOM | 3541 | CB | PRO B | 100 | 17.451 | 67.855 | 55.016 | 1.00 | 0.00 XXXX | 3541 |
| ATOM | 3542 | CG | PRO B | 100 | 17.263 | 66.757 | 54.024 | 1.00 | 0.00 XXXX | 3542 |
| ATOM | 3543 | CD | PRO B | 100 | 17.185 | 65.499 | 54.829 | 1.00 | 0.00 XXXX | 3543 |
| ATOM | 3544 | N | VAL B | 101 | 14.304 | 67.464 | 55.656 | 1.00 | 0.00 XXXX | 3544 |
| ATOM | 3545 | CA | VAL B | 101 | 12.957 | 68.022 | 55.634 | 1.00 | 0.00 XXXX | 3545 |
| ATOM | 3546 | C | VAL B | 101 | 12.251 | 67.885 | 56.984 | 1.00 | 0.00 XXXX | 3546 |
| ATOM | 3547 | O | VAL B | 101 | 11.661 | 68.845 | 57.481 | 1.00 | 0.00 XXXX | 3547 |
| ATOM | 3548 | CB | VAL B | 101 | 12.093 | 67.358 | 54.545 | 1.00 | 0.00 XXXX | 3548 |
| ATOM | 3549 | CG1 | VAL B | 101 | 10.699 | 67.962 | 54.536 | 1.00 | 0.00 XXXX | 3549 |
| ATOM | 3550 | CG2 | VAL B | 101 | 12.753 | 67.508 | 53.181 | 1.00 | 0.00 XXXX | 3550 |
| ATOM | 3551 | N | VAL B | 102 | 12.308 | 66.694 | 57.574 | 1.00 | 0.00 XXXX | 3551 |
| ATOM | 3552 | CA | VAL B | 102 | 11.676 | 66.465 | 58.870 | 1.00 | 0.00 XXXX | 3552 |
| ATOM | 3553 | C | VAL B | 102 | 12.424 | 67.180 | 59.990 | 1.00 | 0.00 XXXX | 3553 |
| ATOM | 3554 | O | VAL B | 102 | 11.818 | 67.623 | 60.963 | 1.00 | 0.00 XXXX | 3554 |
| ATOM | 3555 | CB | VAL B | 102 | 11.581 | 64.962 | 59.208 | 1.00 | 0.00 XXXX | 3555 |
| ATOM | 3556 | CG1 | VAL B | 102 | 10.475 | 64.306 | 58.396 | 1.00 | 0.00 XXXX | 3556 |
| ATOM | 3557 | CG2 | VAL B | 102 | 12.921 | 64.272 | 58.980 | 1.00 | 0.00 XXXX | 3557 |
| ATOM | 3558 | N | GLU B | 103 | 13.740 | 67.298 | 59.847 | 1.00 | 0.00 XXXX | 3558 |
| ATOM | 3559 | CA | GLU B | 103 | 14.544 | 68.004 | 60.839 | 1.00 | 0.00 XXXX | 3559 |
| ATOM | 3560 | C | GLU B | 103 | 14.252 | 69.501 | 60.794 | 1.00 | 0.00 XXXX | 3560 |
| ATOM | 3561 | O | GLU B | 103 | 14.123 | 70.150 | 61.833 | 1.00 | 0.00 XXXX | 3561 |
| ATOM | 3562 | CB | GLU B | 103 | 16.039 | 67.744 | 60.627 | 1.00 | 0.00 XXXX | 3562 |
| ATOM | 3563 | CG | GLU B | 103 | 16.488 | 66.345 | 61.027 | 1.00 | 0.00 XXXX | 3563 |
| ATOM | 3564 | CD | GLU B | 103 | 17.995 | 66.234 | 61.189 | 1.00 | 0.00 XXXX | 3564 |
| ATOM | 3565 | OE1 | GLU B | 103 | 18.704 | 67.224 | 60.910 | 1.00 | 0.00 XXXX | 3565 |
| ATOM | 3566 | OE2 | GLU B | 103 | 18.470 | 65.157 | 61.607 | 1.00 | 0.00 XXXX | 3566 |
| ATOM | 3567 | N | GLU B | 104 | 14.154 | 70.044 | 59.585 | 1.00 | 0.00 XXXX | 3567 |
| ATOM | 3568 | CA | GLU B | 104 | 13.915 | 71.470 | 59.398 | 1.00 | 0.00 XXXX | 3568 |
| ATOM | 3569 | C | GLU B | 104 | 12.524 | 71.885 | 59.871 | 1.00 | 0.00 XXXX | 3569 |
| ATOM | 3570 | O | GLU B | 104 | 12.341 | 72.978 | 60.408 | 1.00 | 0.00 XXXX | 3570 |
| ATOM | 3571 | CB | GLU B | 104 | 14.089 | 71.842 | 57.924 | 1.00 | 0.00 XXXX | 3571 |
| ATOM | 3572 | CG | GLU B | 104 | 14.168 | 73.334 | 57.655 | 1.00 | 0.00 XXXX | 3572 |
| ATOM | 3573 | CD | GLU B | 104 | 14.268 | 73.654 | 56.175 | 1.00 | 0.00 XXXX | 3573 |
| ATOM | 3574 | OE1 | GLU B | 104 | 13.918 | 72.782 | 55.350 | 1.00 | 0.00 XXXX | 3574 |
| ATOM | 3575 | OE2 | GLU B | 104 | 14.696 | 74.778 | 55.837 | 1.00 | 0.00 XXXX | 3575 |
| ATOM | 3576 | N | ASN B | 105 | 11.548 | 71.007 | 59.670 | 1.00 | 0.00 XXXX | 3576 |
| ATOM | 3577 | CA | ASN B | 105 | 10.170 | 71.286 | 60.061 | 1.00 | 0.00 XXXX | 3577 |
| ATOM | 3578 | C | ASN B | 105 | 9.822 | 70.721 | 61.435 | 1.00 | 0.00 XXXX | 3578 |
| ATOM | 3579 | O | ASN B | 105 | 8.689 | 70.856 | 61.899 | 1.00 | 0.00 XXXX | 3579 |
| ATOM | 3580 | CB | ASN B | 105 | 9.206 | 70.728 | 59.013 | 1.00 | 0.00 XXXX | 3580 |
| ATOM | 3581 | CG | ASN B | 105 | 9.323 | 71.437 | 57.679 | 1.00 | 0.00 XXXX | 3581 |
| ATOM | 3582 | OD1 | ASN B | 105 | 8.691 | 72.469 | 57.452 | 1.00 | 0.00 XXXX | 3582 |
| ATOM | 3583 | ND2 | ASN B | 105 | 10.138 | 70.887 | 56.788 | 1.00 | 0.00 XXXX | 3583 |
| ATOM | 3584 | N | ASN B | 106 | 10.806 | 70.102 | 62.080 | 1.00 | 0.00 XXXX | 3584 |
| ATOM | 3585 | CA | ASN B | 106 | 10.585 | 69.353 | 63.314 | 1.00 | 0.00 XXXX | 3585 |
| ATOM | 3586 | C | ASN B | 106 | 9.414 | 68.385 | 63.179 | 1.00 | 0.00 XXXX | 3586 |
| ATOM | 3587 | O | ASN B | 106 | 8.528 | 68.336 | 64.032 | 1.00 | 0.00 XXXX | 3587 |
| ATOM | 3588 | CB | ASN B | 106 | 10.347 | 70.298 | 64.494 | 1.00 | 0.00 XXXX | 3588 |
| ATOM | 3589 | CG | ASN B | 106 | 10.507 | 69.602 | 65.837 | 1.00 | 0.00 XXXX | 3589 |
| ATOM | 3590 | OD1 | ASN B | 106 | 11.260 | 68.636 | 65.961 | 1.00 | 0.00 XXXX | 3590 |
| ATOM | 3591 | ND2 | ASN B | 106 | 9.793 | 70.088 | 66.847 | 1.00 | 0.00 XXXX | 3591 |
| ATOM | 3592 | N | GLY B | 107 | 9.416 | 67.619 | 62.094 | 1.00 | 0.00 XXXX | 3592 |
| ATOM | 3593 | CA | GLY B | 107 | 8.422 | 66.585 | 61.893 | 1.00 | 0.00 XXXX | 3593 |
| ATOM | 3594 | C | GLY B | 107 | 8.969 | 65.247 | 62.342 | 1.00 | 0.00 XXXX | 3594 |
| ATOM | 3595 | O | GLY B | 107 | 10.068 | 65.172 | 62.894 | 1.00 | 0.00 XXXX | 3595 |
| ATOM | 3596 | N | LEU B | 108 | 8.208 | 64.185 | 62.106 | 1.00 | 0.00 XXXX | 3596 |
| ATOM | 3597 | CA | LEU B | 108 | 8.669 | 62.845 | 62.442 | 1.00 | 0.00 XXXX | 3597 |
| ATOM | 3598 | C | LEU B | 108 | 8.532 | 61.891 | 61.266 | 1.00 | 0.00 XXXX | 3598 |
| ATOM | 3599 | O | LEU B | 108 | 7.497 | 61.849 | 60.602 | 1.00 | 0.00 XXXX | 3599 |
| ATOM | 3600 | CB | LEU B | 108 | 7.898 | 62.293 | 63.644 | 1.00 | 0.00 XXXX | 3600 |
| ATOM | 3601 | CG | LEU B | 108 | 8.224 | 62.892 | 65.013 | 1.00 | 0.00 XXXX | 3601 |
| ATOM | 3602 | CD1 | LEU B | 108 | 7.429 | 62.188 | 66.101 | 1.00 | 0.00 XXXX | 3602 |
| ATOM | 3603 | CD2 | LEU B | 108 | 9.718 | 62.813 | 65.297 | 1.00 | 0.00 XXXX | 3603 |
| ATOM | 3604 | N | LEU B | 109 | 9.593 | 61.133 | 61.014 | 1.00 | 0.00 XXXX | 3604 |
| ATOM | 3605 | CA | LEU B | 109 | 9.555 | 60.031 | 60.064 | 1.00 | 0.00 XXXX | 3605 |

-continued

| | | | | | | | | | | |
|---|---|---|---|---|---|---|---|---|---|---|
| ATOM | 3606 | C | LEU B | 109 | 9.713 | 58.703 | 60.790 | 1.00 | 0.00 | XXXX | 3606 |
| ATOM | 3607 | O | LEU B | 109 | 10.671 | 58.511 | 61.539 | 1.00 | 0.00 | XXXX | 3607 |
| ATOM | 3608 | CB | LEU B | 109 | 10.655 | 60.180 | 59.010 | 1.00 | 0.00 | XXXX | 3608 |
| ATOM | 3609 | CG | LEU B | 109 | 10.838 | 58.982 | 58.072 | 1.00 | 0.00 | XXXX | 3609 |
| ATOM | 3610 | CD1 | LEU B | 109 | 9.686 | 58.879 | 57.082 | 1.00 | 0.00 | XXXX | 3610 |
| ATOM | 3611 | CD2 | LEU B | 109 | 12.178 | 59.056 | 57.349 | 1.00 | 0.00 | XXXX | 3611 |
| ATOM | 3612 | N | PHE B | 110 | 8.772 | 57.791 | 60.575 | 1.00 | 0.00 | XXXX | 3612 |
| ATOM | 3613 | CA | PHE B | 110 | 8.943 | 56.423 | 61.043 | 1.00 | 0.00 | XXXX | 3613 |
| ATOM | 3614 | C | PHE B | 110 | 9.407 | 55.542 | 59.886 | 1.00 | 0.00 | XXXX | 3614 |
| ATOM | 3615 | O | PHE B | 110 | 8.665 | 55.278 | 58.938 | 1.00 | 0.00 | XXXX | 3615 |
| ATOM | 3616 | CB | PHE B | 110 | 7.655 | 55.892 | 61.679 | 1.00 | 0.00 | XXXX | 3616 |
| ATOM | 3617 | CG | PHE B | 110 | 7.549 | 56.189 | 63.151 | 1.00 | 0.00 | XXXX | 3617 |
| ATOM | 3618 | CD1 | PHE B | 110 | 7.386 | 57.489 | 63.600 | 1.00 | 0.00 | XXXX | 3618 |
| ATOM | 3619 | CD2 | PHE B | 110 | 7.643 | 55.171 | 64.087 | 1.00 | 0.00 | XXXX | 3619 |
| ATOM | 3620 | CE1 | PHE B | 110 | 7.303 | 57.768 | 64.954 | 1.00 | 0.00 | XXXX | 3620 |
| ATOM | 3621 | CE2 | PHE B | 110 | 7.561 | 55.443 | 65.443 | 1.00 | 0.00 | XXXX | 3621 |
| ATOM | 3622 | CZ | PHE B | 110 | 7.391 | 56.743 | 65.876 | 1.00 | 0.00 | XXXX | 3622 |
| ATOM | 3623 | N | TYR B | 111 | 10.657 | 55.105 | 59.991 | 1.00 | 0.00 | XXXX | 3623 |
| ATOM | 3624 | CA | TYR B | 111 | 11.377 | 54.418 | 58.924 | 1.00 | 0.00 | XXXX | 3624 |
| ATOM | 3625 | C | TYR B | 111 | 11.528 | 52.930 | 59.238 | 1.00 | 0.00 | XXXX | 3625 |
| ATOM | 3626 | O | TYR B | 111 | 12.179 | 52.565 | 60.215 | 1.00 | 0.00 | XXXX | 3626 |
| ATOM | 3627 | CB | TYR B | 111 | 12.741 | 55.092 | 58.745 | 1.00 | 0.00 | XXXX | 3627 |
| ATOM | 3628 | CG | TYR B | 111 | 13.706 | 54.413 | 57.811 | 1.00 | 0.00 | XXXX | 3628 |
| ATOM | 3629 | CD1 | TYR B | 111 | 14.855 | 53.808 | 58.300 | 1.00 | 0.00 | XXXX | 3629 |
| ATOM | 3630 | CD2 | TYR B | 111 | 13.488 | 54.398 | 56.440 | 1.00 | 0.00 | XXXX | 3630 |
| ATOM | 3631 | CE1 | TYR B | 111 | 15.754 | 53.198 | 57.456 | 1.00 | 0.00 | XXXX | 3631 |
| ATOM | 3632 | CE2 | TYR B | 111 | 14.383 | 53.788 | 55.586 | 1.00 | 0.00 | XXXX | 3632 |
| ATOM | 3633 | CZ | TYR B | 111 | 15.514 | 53.189 | 56.101 | 1.00 | 0.00 | XXXX | 3633 |
| ATOM | 3634 | OH | TYR B | 111 | 16.413 | 52.576 | 55.260 | 1.00 | 0.00 | XXXX | 3634 |
| ATOM | 3635 | N | PRO B | 112 | 10.920 | 52.065 | 58.407 | 1.00 | 0.00 | XXXX | 3635 |
| ATOM | 3636 | CA | PRO B | 112 | 10.791 | 50.636 | 58.719 | 1.00 | 0.00 | XXXX | 3636 |
| ATOM | 3637 | C | PRO B | 112 | 11.853 | 49.703 | 58.126 | 1.00 | 0.00 | XXXX | 3637 |
| ATOM | 3638 | O | PRO B | 112 | 11.687 | 48.489 | 58.241 | 1.00 | 0.00 | XXXX | 3638 |
| ATOM | 3639 | CB | PRO B | 112 | 9.426 | 50.297 | 58.121 | 1.00 | 0.00 | XXXX | 3639 |
| ATOM | 3640 | CG | PRO B | 112 | 9.363 | 51.158 | 56.900 | 1.00 | 0.00 | XXXX | 3640 |
| ATOM | 3641 | CD | PRO B | 112 | 10.102 | 52.441 | 57.241 | 1.00 | 0.00 | XXXX | 3641 |
| ATOM | 3642 | N | VAL B | 113 | 12.912 | 50.228 | 57.519 | 1.00 | 0.00 | XXXX | 3642 |
| ATOM | 3643 | CA | VAL B | 113 | 13.821 | 49.365 | 56.766 | 1.00 | 0.00 | XXXX | 3643 |
| ATOM | 3644 | C | VAL B | 113 | 15.228 | 49.237 | 57.358 | 1.00 | 0.00 | XXXX | 3644 |
| ATOM | 3645 | O | VAL B | 113 | 15.803 | 50.209 | 57.850 | 1.00 | 0.00 | XXXX | 3645 |
| ATOM | 3646 | CB | VAL B | 113 | 13.957 | 49.852 | 55.305 | 1.00 | 0.00 | XXXX | 3646 |
| ATOM | 3647 | CG1 | VAL B | 113 | 14.866 | 48.921 | 54.516 | 1.00 | 0.00 | XXXX | 3647 |
| ATOM | 3648 | CG2 | VAL B | 113 | 12.585 | 49.950 | 54.645 | 1.00 | 0.00 | XXXX | 3648 |
| ATOM | 3649 | N | GLN B | 114 | 15.759 | 48.016 | 57.318 | 1.00 | 0.00 | XXXX | 3649 |
| ATOM | 3650 | CA | GLN B | 114 | 17.159 | 47.747 | 57.646 | 1.00 | 0.00 | XXXX | 3650 |
| ATOM | 3651 | C | GLN B | 114 | 18.092 | 48.722 | 56.929 | 1.00 | 0.00 | XXXX | 3651 |
| ATOM | 3652 | O | GLN B | 114 | 17.813 | 49.133 | 55.805 | 1.00 | 0.00 | XXXX | 3652 |
| ATOM | 3653 | CB | GLN B | 114 | 17.518 | 46.302 | 57.281 | 1.00 | 0.00 | XXXX | 3653 |
| ATOM | 3654 | CG | GLN B | 114 | 17.214 | 45.919 | 55.832 | 1.00 | 0.00 | XXXX | 3654 |
| ATOM | 3655 | CD | GLN B | 114 | 18.267 | 46.406 | 54.849 | 1.00 | 0.00 | XXXX | 3655 |
| ATOM | 3656 | OE1 | GLN B | 114 | 17.958 | 46.739 | 53.704 | 1.00 | 0.00 | XXXX | 3656 |
| ATOM | 3657 | NE2 | GLN B | 114 | 19.519 | 46.443 | 55.292 | 1.00 | 0.00 | XXXX | 3657 |
| ATOM | 3658 | N | TYR B | 115 | 19.194 | 49.098 | 57.570 | 1.00 | 0.00 | XXXX | 3658 |
| ATOM | 3659 | CA | TYR B | 115 | 20.104 | 50.051 | 56.943 | 1.00 | 0.00 | XXXX | 3659 |
| ATOM | 3660 | C | TYR B | 115 | 21.504 | 50.055 | 57.558 | 1.00 | 0.00 | XXXX | 3660 |
| ATOM | 3661 | O | TYR B | 115 | 21.818 | 49.245 | 58.432 | 1.00 | 0.00 | XXXX | 3661 |
| ATOM | 3662 | CB | TYR B | 115 | 19.494 | 51.457 | 56.991 | 1.00 | 0.00 | XXXX | 3662 |
| ATOM | 3663 | CG | TYR B | 115 | 19.752 | 52.222 | 58.268 | 1.00 | 0.00 | XXXX | 3663 |
| ATOM | 3664 | CD1 | TYR B | 115 | 19.256 | 51.775 | 59.486 | 1.00 | 0.00 | XXXX | 3664 |
| ATOM | 3665 | CD2 | TYR B | 115 | 20.471 | 53.409 | 58.250 | 1.00 | 0.00 | XXXX | 3665 |
| ATOM | 3666 | CE1 | TYR B | 115 | 19.486 | 52.481 | 60.653 | 1.00 | 0.00 | XXXX | 3666 |
| ATOM | 3667 | CE2 | TYR B | 115 | 20.702 | 54.122 | 59.408 | 1.00 | 0.00 | XXXX | 3667 |
| ATOM | 3668 | CZ | TYR B | 115 | 20.210 | 53.656 | 60.606 | 1.00 | 0.00 | XXXX | 3668 |
| ATOM | 3669 | OH | TYR B | 115 | 20.447 | 54.369 | 61.758 | 1.00 | 0.00 | XXXX | 3669 |
| ATOM | 3670 | N | GLU B | 116 | 22.334 | 50.981 | 57.088 | 1.00 | 0.00 | XXXX | 3670 |
| ATOM | 3671 | CA | GLU B | 116 | 23.764 | 50.973 | 57.381 | 1.00 | 0.00 | XXXX | 3671 |
| ATOM | 3672 | C | GLU B | 116 | 24.129 | 51.555 | 58.743 | 1.00 | 0.00 | XXXX | 3672 |
| ATOM | 3673 | O | GLU B | 116 | 25.265 | 51.411 | 59.196 | 1.00 | 0.00 | XXXX | 3673 |
| ATOM | 3674 | CB | GLU B | 116 | 24.516 | 51.739 | 56.289 | 1.00 | 0.00 | XXXX | 3674 |
| ATOM | 3675 | CG | GLU B | 116 | 24.287 | 53.248 | 56.307 | 1.00 | 0.00 | XXXX | 3675 |
| ATOM | 3676 | CD | GLU B | 116 | 22.955 | 53.655 | 55.701 | 1.00 | 0.00 | XXXX | 3676 |
| ATOM | 3677 | OE1 | GLU B | 116 | 22.259 | 52.781 | 55.143 | 1.00 | 0.00 | XXXX | 3677 |
| ATOM | 3678 | OE2 | GLU B | 116 | 22.609 | 54.854 | 55.773 | 1.00 | 0.00 | XXXX | 3678 |
| ATOM | 3679 | N | GLY B | 117 | 23.179 | 52.223 | 59.386 | 1.00 | 0.00 | XXXX | 3679 |
| ATOM | 3680 | CA | GLY B | 117 | 23.457 | 52.888 | 60.645 | 1.00 | 0.00 | XXXX | 3680 |
| ATOM | 3681 | C | GLY B | 117 | 24.273 | 54.147 | 60.426 | 1.00 | 0.00 | XXXX | 3681 |
| ATOM | 3682 | O | GLY B | 117 | 24.104 | 54.833 | 59.418 | 1.00 | 0.00 | XXXX | 3682 |
| ATOM | 3683 | N | LEU B | 118 | 25.167 | 54.443 | 61.366 | 1.00 | 0.00 | XXXX | 3683 |
| ATOM | 3684 | CA | LEU B | 118 | 26.009 | 55.632 | 61.281 | 1.00 | 0.00 | XXXX | 3684 |

| | | | | | | | | | | |
|---|---|---|---|---|---|---|---|---|---|---|
| ATOM | 3685 | C | LEU B | 118 | 25.147 | 56.880 | 61.161 | 1.00 | 0.00 XXXX | 3685 |
| ATOM | 3686 | O | LEU B | 118 | 25.533 | 57.865 | 60.531 | 1.00 | 0.00 XXXX | 3686 |
| ATOM | 3687 | CB | LEU B | 118 | 26.973 | 55.530 | 60.097 | 1.00 | 0.00 XXXX | 3687 |
| ATOM | 3688 | CG | LEU B | 118 | 27.926 | 54.332 | 60.122 | 1.00 | 0.00 XXXX | 3688 |
| ATOM | 3689 | CD1 | LEU B | 118 | 28.918 | 54.399 | 58.971 | 1.00 | 0.00 XXXX | 3689 |
| ATOM | 3690 | CD2 | LEU B | 118 | 28.651 | 54.246 | 61.459 | 1.00 | 0.00 XXXX | 3690 |
| ATOM | 3691 | N | GLU B | 119 | 23.974 | 56.824 | 61.779 | 1.00 | 0.00 XXXX | 3691 |
| ATOM | 3692 | CA | GLU B | 119 | 23.013 | 57.913 | 61.725 | 1.00 | 0.00 XXXX | 3692 |
| ATOM | 3693 | C | GLU B | 119 | 22.112 | 57.862 | 62.953 | 1.00 | 0.00 XXXX | 3693 |
| ATOM | 3694 | O | GLU B | 119 | 21.871 | 56.791 | 63.507 | 1.00 | 0.00 XXXX | 3694 |
| ATOM | 3695 | CB | GLU B | 119 | 22.181 | 57.826 | 60.443 | 1.00 | 0.00 XXXX | 3695 |
| ATOM | 3696 | CG | GLU B | 119 | 21.226 | 58.985 | 60.220 | 1.00 | 0.00 XXXX | 3696 |
| ATOM | 3697 | CD | GLU B | 119 | 20.300 | 58.748 | 59.039 | 1.00 | 0.00 XXXX | 3697 |
| ATOM | 3698 | OE1 | GLU B | 119 | 20.785 | 58.781 | 57.887 | 1.00 | 0.00 XXXX | 3698 |
| ATOM | 3699 | OE2 | GLU B | 119 | 19.089 | 58.528 | 59.262 | 1.00 | 0.00 XXXX | 3699 |
| ATOM | 3700 | N | SER B | 120 | 21.618 | 59.020 | 63.376 | 1.00 | 0.00 XXXX | 3700 |
| ATOM | 3701 | CA | SER B | 120 | 20.656 | 59.075 | 64.470 | 1.00 | 0.00 XXXX | 3701 |
| ATOM | 3702 | C | SER B | 120 | 19.969 | 60.433 | 64.527 | 1.00 | 0.00 XXXX | 3702 |
| ATOM | 3703 | O | SER B | 120 | 20.260 | 61.251 | 65.399 | 1.00 | 0.00 XXXX | 3703 |
| ATOM | 3704 | CB | SER B | 120 | 21.338 | 58.774 | 65.807 | 1.00 | 0.00 XXXX | 3704 |
| ATOM | 3705 | OG | SER B | 120 | 21.526 | 57.380 | 65.982 | 1.00 | 0.00 XXXX | 3705 |
| ATOM | 3706 | N | SER B | 121 | 19.056 | 60.662 | 63.590 | 1.00 | 0.00 XXXX | 3706 |
| ATOM | 3707 | CA | SER B | 121 | 18.291 | 61.902 | 63.545 | 1.00 | 0.00 XXXX | 3707 |
| ATOM | 3708 | C | SER B | 121 | 17.262 | 61.954 | 64.668 | 1.00 | 0.00 XXXX | 3708 |
| ATOM | 3709 | O | SER B | 121 | 16.546 | 60.982 | 64.907 | 1.00 | 0.00 XXXX | 3709 |
| ATOM | 3710 | CB | SER B | 121 | 17.598 | 62.054 | 62.189 | 1.00 | 0.00 XXXX | 3710 |
| ATOM | 3711 | OG | SER B | 121 | 16.687 | 63.138 | 62.194 | 1.00 | 0.00 XXXX | 3711 |
| ATOM | 3712 | N | PRO B | 122 | 17.184 | 63.095 | 65.365 | 1.00 | 0.00 XXXX | 3712 |
| ATOM | 3713 | CA | PRO B | 122 | 16.168 | 63.286 | 66.405 | 1.00 | 0.00 XXXX | 3713 |
| ATOM | 3714 | C | PRO B | 122 | 14.755 | 63.300 | 65.825 | 1.00 | 0.00 XXXX | 3714 |
| ATOM | 3715 | O | PRO B | 122 | 13.778 | 63.218 | 66.569 | 1.00 | 0.00 XXXX | 3715 |
| ATOM | 3716 | CB | PRO B | 122 | 16.529 | 64.650 | 67.001 | 1.00 | 0.00 XXXX | 3716 |
| ATOM | 3717 | CG | PRO B | 122 | 17.242 | 65.361 | 65.895 | 1.00 | 0.00 XXXX | 3717 |
| ATOM | 3718 | CD | PRO B | 122 | 18.021 | 64.293 | 65.182 | 1.00 | 0.00 XXXX | 3718 |
| ATOM | 3719 | N | ASN B | 123 | 14.658 | 63.402 | 64.503 | 1.00 | 0.00 XXXX | 3719 |
| ATOM | 3720 | CA | ASN B | 123 | 13.367 | 63.461 | 63.828 | 1.00 | 0.00 XXXX | 3720 |
| ATOM | 3721 | C | ASN B | 123 | 13.046 | 62.189 | 63.051 | 1.00 | 0.00 XXXX | 3721 |
| ATOM | 3722 | O | ASN B | 123 | 12.147 | 62.175 | 62.210 | 1.00 | 0.00 XXXX | 3722 |
| ATOM | 3723 | CB | ASN B | 123 | 13.323 | 64.667 | 62.890 | 1.00 | 0.00 XXXX | 3723 |
| ATOM | 3724 | CG | ASN B | 123 | 13.425 | 65.982 | 63.636 | 1.00 | 0.00 XXXX | 3724 |
| ATOM | 3725 | OD1 | ASN B | 123 | 14.515 | 66.527 | 63.808 | 1.00 | 0.00 XXXX | 3725 |
| ATOM | 3726 | ND2 | ASN B | 123 | 12.287 | 66.496 | 64.088 | 1.00 | 0.00 XXXX | 3726 |
| ATOM | 3727 | N | ILE B | 124 | 13.783 | 61.121 | 63.335 | 1.00 | 0.00 XXXX | 3727 |
| ATOM | 3728 | CA | ILE B | 124 | 13.503 | 59.828 | 62.729 | 1.00 | 0.00 XXXX | 3728 |
| ATOM | 3729 | C | ILE B | 124 | 13.431 | 58.728 | 63.777 | 1.00 | 0.00 XXXX | 3729 |
| ATOM | 3730 | O | ILE B | 124 | 14.280 | 58.645 | 64.662 | 1.00 | 0.00 XXXX | 3730 |
| ATOM | 3731 | CB | ILE B | 124 | 14.569 | 59.437 | 61.684 | 1.00 | 0.00 XXXX | 3731 |
| ATOM | 3732 | CG1 | ILE B | 124 | 14.648 | 60.485 | 60.574 | 1.00 | 0.00 XXXX | 3732 |
| ATOM | 3733 | CG2 | ILE B | 124 | 14.259 | 58.067 | 61.093 | 1.00 | 0.00 XXXX | 3733 |
| ATOM | 3734 | CD1 | ILE B | 124 | 15.661 | 60.150 | 59.501 | 1.00 | 0.00 XXXX | 3734 |
| ATOM | 3735 | N | PHE B | 125 | 12.408 | 57.886 | 63.673 | 1.00 | 0.00 XXXX | 3735 |
| ATOM | 3736 | CA | PHE B | 125 | 12.351 | 56.666 | 64.465 | 1.00 | 0.00 XXXX | 3736 |
| ATOM | 3737 | C | PHE B | 125 | 12.614 | 55.467 | 63.563 | 1.00 | 0.00 XXXX | 3737 |
| ATOM | 3738 | O | PHE B | 125 | 11.947 | 55.281 | 62.544 | 1.00 | 0.00 XXXX | 3738 |
| ATOM | 3739 | CB | PHE B | 125 | 11.006 | 56.539 | 65.185 | 1.00 | 0.00 XXXX | 3739 |
| ATOM | 3740 | CG | PHE B | 125 | 10.911 | 57.382 | 66.424 | 1.00 | 0.00 XXXX | 3740 |
| ATOM | 3741 | CD1 | PHE B | 125 | 11.253 | 56.858 | 67.661 | 1.00 | 0.00 XXXX | 3741 |
| ATOM | 3742 | CD2 | PHE B | 125 | 10.508 | 58.705 | 66.351 | 1.00 | 0.00 XXXX | 3742 |
| ATOM | 3743 | CE1 | PHE B | 125 | 11.182 | 57.633 | 68.802 | 1.00 | 0.00 XXXX | 3743 |
| ATOM | 3744 | CE2 | PHE B | 125 | 10.433 | 59.484 | 67.490 | 1.00 | 0.00 XXXX | 3744 |
| ATOM | 3745 | CZ | PHE B | 125 | 10.771 | 58.949 | 68.717 | 1.00 | 0.00 XXXX | 3745 |
| ATOM | 3746 | N | TYR B | 126 | 13.595 | 54.660 | 63.949 | 1.00 | 0.00 XXXX | 3746 |
| ATOM | 3747 | CA | TYR B | 126 | 14.100 | 53.592 | 63.098 | 1.00 | 0.00 XXXX | 3747 |
| ATOM | 3748 | C | TYR B | 126 | 13.552 | 52.245 | 63.543 | 1.00 | 0.00 XXXX | 3748 |
| ATOM | 3749 | O | TYR B | 126 | 13.964 | 51.706 | 64.571 | 1.00 | 0.00 XXXX | 3749 |
| ATOM | 3750 | CB | TYR B | 126 | 15.632 | 53.563 | 63.125 | 1.00 | 0.00 XXXX | 3750 |
| ATOM | 3751 | CG | TYR B | 126 | 16.299 | 54.873 | 62.755 | 1.00 | 0.00 XXXX | 3751 |
| ATOM | 3752 | CD1 | TYR B | 126 | 16.925 | 55.034 | 61.525 | 1.00 | 0.00 XXXX | 3752 |
| ATOM | 3753 | CD2 | TYR B | 126 | 16.319 | 55.942 | 63.642 | 1.00 | 0.00 XXXX | 3753 |
| ATOM | 3754 | CE1 | TYR B | 126 | 17.545 | 56.226 | 61.186 | 1.00 | 0.00 XXXX | 3754 |
| ATOM | 3755 | CE2 | TYR B | 126 | 16.933 | 57.140 | 63.310 | 1.00 | 0.00 XXXX | 3755 |
| ATOM | 3756 | CZ | TYR B | 126 | 17.546 | 57.276 | 62.081 | 1.00 | 0.00 XXXX | 3756 |
| ATOM | 3757 | OH | TYR B | 126 | 18.161 | 58.462 | 61.743 | 1.00 | 0.00 XXXX | 3757 |
| ATOM | 3758 | N | MET B | 127 | 12.622 | 51.702 | 62.764 | 1.00 | 0.00 XXXX | 3758 |
| ATOM | 3759 | CA | MET B | 127 | 11.993 | 50.433 | 63.100 | 1.00 | 0.00 XXXX | 3759 |
| ATOM | 3760 | C | MET B | 127 | 12.739 | 49.279 | 62.443 | 1.00 | 0.00 XXXX | 3760 |
| ATOM | 3761 | O | MET B | 127 | 12.556 | 48.119 | 62.812 | 1.00 | 0.00 XXXX | 3761 |
| ATOM | 3762 | CB | MET B | 127 | 10.522 | 50.427 | 62.678 | 1.00 | 0.00 XXXX | 3762 |
| ATOM | 3763 | CG | MET B | 127 | 9.694 | 51.555 | 63.282 | 1.00 | 0.00 XXXX | 3763 |

-continued

| | | | | | | | | | | |
|---|---|---|---|---|---|---|---|---|---|---|
| ATOM | 3764 | SD | MET B | 127 | 9.547 | 51.471 | 65.080 | 1.00 | 0.00 | XXXX | 3764 |
| ATOM | 3765 | CE | MET B | 127 | 10.731 | 52.720 | 65.575 | 1.00 | 0.00 | XXXX | 3765 |
| ATOM | 3766 | N | GLY B | 128 | 13.581 | 49.605 | 61.467 | 1.00 | 0.00 | XXXX | 3766 |
| ATOM | 3767 | CA | GLY B | 128 | 14.389 | 48.605 | 60.795 | 1.00 | 0.00 | XXXX | 3767 |
| ATOM | 3768 | C | GLY B | 128 | 15.712 | 48.382 | 61.503 | 1.00 | 0.00 | XXXX | 3768 |
| ATOM | 3769 | O | GLY B | 128 | 16.139 | 49.202 | 62.316 | 1.00 | 0.00 | XXXX | 3769 |
| ATOM | 3770 | N | ALA B | 129 | 16.361 | 47.266 | 61.188 | 1.00 | 0.00 | XXXX | 3770 |
| ATOM | 3771 | CA | ALA B | 129 | 17.595 | 46.867 | 61.860 | 1.00 | 0.00 | XXXX | 3771 |
| ATOM | 3772 | C | ALA B | 129 | 18.725 | 47.880 | 61.705 | 1.00 | 0.00 | XXXX | 3772 |
| ATOM | 3773 | O | ALA B | 129 | 18.936 | 48.434 | 60.625 | 1.00 | 0.00 | XXXX | 3773 |
| ATOM | 3774 | CB | ALA B | 129 | 18.048 | 45.509 | 61.345 | 1.00 | 0.00 | XXXX | 3774 |
| ATOM | 3775 | N | ALA B | 130 | 19.445 | 48.116 | 62.798 | 1.00 | 0.00 | XXXX | 3775 |
| ATOM | 3776 | CA | ALA B | 130 | 20.760 | 48.739 | 62.731 | 1.00 | 0.00 | XXXX | 3776 |
| ATOM | 3777 | C | ALA B | 130 | 21.767 | 47.660 | 62.354 | 1.00 | 0.00 | XXXX | 3777 |
| ATOM | 3778 | O | ALA B | 130 | 21.464 | 46.471 | 62.462 | 1.00 | 0.00 | XXXX | 3778 |
| ATOM | 3779 | CB | ALA B | 130 | 21.124 | 49.391 | 64.053 | 1.00 | 0.00 | XXXX | 3779 |
| ATOM | 3780 | N | PRO B | 131 | 22.967 | 48.063 | 61.912 | 1.00 | 0.00 | XXXX | 3780 |
| ATOM | 3781 | CA | PRO B | 131 | 23.939 | 47.089 | 61.397 | 1.00 | 0.00 | XXXX | 3781 |
| ATOM | 3782 | C | PRO B | 131 | 24.337 | 46.015 | 62.415 | 1.00 | 0.00 | XXXX | 3782 |
| ATOM | 3783 | O | PRO B | 131 | 24.593 | 44.876 | 62.022 | 1.00 | 0.00 | XXXX | 3783 |
| ATOM | 3784 | CB | PRO B | 131 | 25.146 | 47.962 | 61.024 | 1.00 | 0.00 | XXXX | 3784 |
| ATOM | 3785 | CG | PRO B | 131 | 24.959 | 49.239 | 61.784 | 1.00 | 0.00 | XXXX | 3785 |
| ATOM | 3786 | CD | PRO B | 131 | 23.482 | 49.441 | 61.868 | 1.00 | 0.00 | XXXX | 3786 |
| ATOM | 3787 | N | ASN B | 132 | 24.377 | 46.363 | 63.697 | 1.00 | 0.00 | XXXX | 3787 |
| ATOM | 3788 | CA | ASN B | 132 | 24.692 | 45.379 | 64.727 | 1.00 | 0.00 | XXXX | 3788 |
| ATOM | 3789 | C | ASN B | 132 | 23.545 | 44.384 | 64.898 | 1.00 | 0.00 | XXXX | 3789 |
| ATOM | 3790 | O | ASN B | 132 | 23.702 | 43.346 | 65.541 | 1.00 | 0.00 | XXXX | 3790 |
| ATOM | 3791 | CB | ASN B | 132 | 25.012 | 46.060 | 66.062 | 1.00 | 0.00 | XXXX | 3791 |
| ATOM | 3792 | CG | ASN B | 132 | 23.784 | 46.641 | 66.737 | 1.00 | 0.00 | XXXX | 3792 |
| ATOM | 3793 | OD1 | ASN B | 132 | 23.046 | 47.428 | 66.144 | 1.00 | 0.00 | XXXX | 3793 |
| ATOM | 3794 | ND2 | ASN B | 132 | 23.562 | 46.255 | 67.989 | 1.00 | 0.00 | XXXX | 3794 |
| ATOM | 3795 | N | GLN B | 133 | 22.394 | 44.708 | 64.316 | 1.00 | 0.00 | XXXX | 3795 |
| ATOM | 3796 | CA | GLN B | 133 | 21.219 | 43.844 | 64.393 | 1.00 | 0.00 | XXXX | 3796 |
| ATOM | 3797 | C | GLN B | 133 | 20.970 | 43.065 | 63.101 | 1.00 | 0.00 | XXXX | 3797 |
| ATOM | 3798 | O | GLN B | 133 | 19.963 | 42.369 | 62.980 | 1.00 | 0.00 | XXXX | 3798 |
| ATOM | 3799 | CB | GLN B | 133 | 19.975 | 44.667 | 64.739 | 1.00 | 0.00 | XXXX | 3799 |
| ATOM | 3800 | CG | GLN B | 133 | 20.070 | 45.432 | 66.049 | 1.00 | 0.00 | XXXX | 3800 |
| ATOM | 3801 | CD | GLN B | 133 | 18.873 | 46.335 | 66.281 | 1.00 | 0.00 | XXXX | 3801 |
| ATOM | 3802 | OE1 | GLN B | 133 | 18.424 | 47.036 | 65.373 | 1.00 | 0.00 | XXXX | 3802 |
| ATOM | 3803 | NE2 | GLN B | 133 | 18.344 | 46.318 | 67.499 | 1.00 | 0.00 | XXXX | 3803 |
| ATOM | 3804 | N | GLN B | 134 | 21.875 | 43.186 | 62.133 | 1.00 | 0.00 | XXXX | 3804 |
| ATOM | 3805 | CA | GLN B | 134 | 21.719 | 42.459 | 60.874 | 1.00 | 0.00 | XXXX | 3805 |
| ATOM | 3806 | C | GLN B | 134 | 23.046 | 42.143 | 60.184 | 1.00 | 0.00 | XXXX | 3806 |
| ATOM | 3807 | O | GLN B | 134 | 23.529 | 41.013 | 60.245 | 1.00 | 0.00 | XXXX | 3807 |
| ATOM | 3808 | CB | GLN B | 134 | 20.816 | 43.243 | 59.914 | 1.00 | 0.00 | XXXX | 3808 |
| ATOM | 3809 | CG | GLN B | 134 | 20.490 | 42.490 | 58.629 | 1.00 | 0.00 | XXXX | 3809 |
| ATOM | 3810 | CD | GLN B | 134 | 19.842 | 43.368 | 57.573 | 1.00 | 0.00 | XXXX | 3810 |
| ATOM | 3811 | OE1 | GLN B | 134 | 20.260 | 44.504 | 57.348 | 1.00 | 0.00 | XXXX | 3811 |
| ATOM | 3812 | NE2 | GLN B | 134 | 18.821 | 42.839 | 56.911 | 1.00 | 0.00 | XXXX | 3812 |
| ATOM | 3813 | N | ILE B | 135 | 23.628 | 43.140 | 59.526 | 1.00 | 0.00 | XXXX | 3813 |
| ATOM | 3814 | CA | ILE B | 135 | 24.814 | 42.927 | 58.696 | 1.00 | 0.00 | XXXX | 3814 |
| ATOM | 3815 | C | ILE B | 135 | 26.012 | 42.378 | 59.474 | 1.00 | 0.00 | XXXX | 3815 |
| ATOM | 3816 | O | ILE B | 135 | 26.711 | 41.483 | 58.994 | 1.00 | 0.00 | XXXX | 3816 |
| ATOM | 3817 | CB | ILE B | 135 | 25.241 | 44.228 | 57.993 | 1.00 | 0.00 | XXXX | 3817 |
| ATOM | 3818 | CG1 | ILE B | 135 | 24.264 | 44.566 | 56.865 | 1.00 | 0.00 | XXXX | 3818 |
| ATOM | 3819 | CG2 | ILE B | 135 | 26.645 | 44.091 | 57.432 | 1.00 | 0.00 | XXXX | 3819 |
| ATOM | 3820 | CD1 | ILE B | 135 | 24.481 | 45.936 | 56.261 | 1.00 | 0.00 | XXXX | 3820 |
| ATOM | 3821 | N | VAL B | 136 | 26.251 | 42.912 | 60.667 | 1.00 | 0.00 | XXXX | 3821 |
| ATOM | 3822 | CA | VAL B | 136 | 27.402 | 42.492 | 61.460 | 1.00 | 0.00 | XXXX | 3822 |
| ATOM | 3823 | C | VAL B | 136 | 27.282 | 41.023 | 61.867 | 1.00 | 0.00 | XXXX | 3823 |
| ATOM | 3824 | O | VAL B | 136 | 28.204 | 40.239 | 61.638 | 1.00 | 0.00 | XXXX | 3824 |
| ATOM | 3825 | CB | VAL B | 136 | 27.579 | 43.362 | 62.721 | 1.00 | 0.00 | XXXX | 3825 |
| ATOM | 3826 | CG1 | VAL B | 136 | 28.604 | 42.739 | 63.657 | 1.00 | 0.00 | XXXX | 3826 |
| ATOM | 3827 | CG2 | VAL B | 136 | 27.997 | 44.772 | 62.334 | 1.00 | 0.00 | XXXX | 3827 |
| ATOM | 3828 | N | PRO B | 137 | 26.146 | 40.643 | 62.473 | 1.00 | 0.00 | XXXX | 3828 |
| ATOM | 3829 | CA | PRO B | 137 | 25.919 | 39.234 | 62.819 | 1.00 | 0.00 | XXXX | 3829 |
| ATOM | 3830 | C | PRO B | 137 | 25.910 | 38.319 | 61.593 | 1.00 | 0.00 | XXXX | 3830 |
| ATOM | 3831 | O | PRO B | 137 | 26.291 | 37.154 | 61.696 | 1.00 | 0.00 | XXXX | 3831 |
| ATOM | 3832 | CB | PRO B | 137 | 24.541 | 39.255 | 63.490 | 1.00 | 0.00 | XXXX | 3832 |
| ATOM | 3833 | CG | PRO B | 137 | 24.382 | 40.655 | 63.986 | 1.00 | 0.00 | XXXX | 3833 |
| ATOM | 3834 | CD | PRO B | 137 | 25.062 | 41.512 | 62.965 | 1.00 | 0.00 | XXXX | 3834 |
| ATOM | 3835 | N | ALA B | 138 | 25.480 | 38.847 | 60.451 | 1.00 | 0.00 | XXXX | 3835 |
| ATOM | 3836 | CA | ALA B | 138 | 25.478 | 38.083 | 59.206 | 1.00 | 0.00 | XXXX | 3836 |
| ATOM | 3837 | C | ALA B | 138 | 26.893 | 37.663 | 58.820 | 1.00 | 0.00 | XXXX | 3837 |
| ATOM | 3838 | O | ALA B | 138 | 27.143 | 36.498 | 58.511 | 1.00 | 0.00 | XXXX | 3838 |
| ATOM | 3839 | CB | ALA B | 138 | 24.840 | 38.894 | 58.086 | 1.00 | 0.00 | XXXX | 3839 |
| ATOM | 3840 | N | VAL B | 139 | 27.811 | 38.623 | 58.844 | 1.00 | 0.00 | XXXX | 3840 |
| ATOM | 3841 | CA | VAL B | 139 | 29.211 | 38.369 | 58.519 | 1.00 | 0.00 | XXXX | 3841 |
| ATOM | 3842 | C | VAL B | 139 | 29.829 | 37.354 | 59.478 | 1.00 | 0.00 | XXXX | 3842 |

-continued

| | | | | | | | | | | |
|---|---|---|---|---|---|---|---|---|---|---|
| ATOM | 3843 | O | VAL | B | 139 | 30.526 | 36.431 | 59.056 | 1.00 | 0.00 XXXX 3843 |
| ATOM | 3844 | CB | VAL | B | 139 | 30.041 | 39.667 | 58.558 | 1.00 | 0.00 XXXX 3844 |
| ATOM | 3845 | CG1 | VAL | B | 139 | 31.524 | 39.356 | 58.393 | 1.00 | 0.00 XXXX 3845 |
| ATOM | 3846 | CG2 | VAL | B | 139 | 29.566 | 40.633 | 57.481 | 1.00 | 0.00 XXXX 3846 |
| ATOM | 3847 | N | LYS | B | 140 | 29.567 | 37.535 | 60.769 | 1.00 | 0.00 XXXX 3847 |
| ATOM | 3848 | CA | LYS | B | 140 | 30.119 | 36.663 | 61.801 | 1.00 | 0.00 XXXX 3848 |
| ATOM | 3849 | C | LYS | B | 140 | 29.665 | 35.213 | 61.641 | 1.00 | 0.00 XXXX 3849 |
| ATOM | 3850 | O | LYS | B | 140 | 30.478 | 34.291 | 61.709 | 1.00 | 0.00 XXXX 3850 |
| ATOM | 3851 | CB | LYS | B | 140 | 29.727 | 37.177 | 63.188 | 1.00 | 0.00 XXXX 3851 |
| ATOM | 3852 | CG | LYS | B | 140 | 30.349 | 36.403 | 64.338 | 1.00 | 0.00 XXXX 3852 |
| ATOM | 3853 | CD | LYS | B | 140 | 31.839 | 36.675 | 64.451 | 1.00 | 0.00 XXXX 3853 |
| ATOM | 3854 | CE | LYS | B | 140 | 32.464 | 35.825 | 65.543 | 1.00 | 0.00 XXXX 3854 |
| ATOM | 3855 | NZ | LYS | B | 140 | 31.685 | 35.903 | 66.809 | 1.00 | 0.00 XXXX 3855 |
| ATOM | 3856 | N | TRP | B | 141 | 28.366 | 35.016 | 61.432 | 1.00 | 0.00 XXXX 3856 |
| ATOM | 3857 | CA | TRP | B | 141 | 27.812 | 33.677 | 61.260 | 1.00 | 0.00 XXXX 3857 |
| ATOM | 3858 | C | TRP | B | 141 | 28.388 | 33.010 | 60.017 | 1.00 | 0.00 XXXX 3858 |
| ATOM | 3859 | O | TRP | B | 141 | 28.736 | 31.829 | 60.038 | 1.00 | 0.00 XXXX 3859 |
| ATOM | 3860 | CB | TRP | B | 141 | 26.285 | 33.732 | 61.172 | 1.00 | 0.00 XXXX 3860 |
| ATOM | 3861 | CG | TRP | B | 141 | 25.639 | 32.386 | 61.007 | 1.00 | 0.00 XXXX 3861 |
| ATOM | 3862 | CD1 | TRP | B | 141 | 25.291 | 31.515 | 61.999 | 1.00 | 0.00 XXXX 3862 |
| ATOM | 3863 | CD2 | TRP | B | 141 | 25.260 | 31.761 | 59.774 | 1.00 | 0.00 XXXX 3863 |
| ATOM | 3864 | NE1 | TRP | B | 141 | 24.721 | 30.386 | 61.461 | 1.00 | 0.00 XXXX 3864 |
| ATOM | 3865 | CE2 | TRP | B | 141 | 24.691 | 30.512 | 60.097 | 1.00 | 0.00 XXXX 3865 |
| ATOM | 3866 | CE3 | TRP | B | 141 | 25.349 | 32.134 | 58.429 | 1.00 | 0.00 XXXX 3866 |
| ATOM | 3867 | CZ2 | TRP | B | 141 | 24.213 | 29.636 | 59.124 | 1.00 | 0.00 XXXX 3867 |
| ATOM | 3868 | CZ3 | TRP | B | 141 | 24.874 | 31.263 | 57.466 | 1.00 | 0.00 XXXX 3868 |
| ATOM | 3869 | CH2 | TRP | B | 141 | 24.313 | 30.029 | 57.818 | 1.00 | 0.00 XXXX 3869 |
| ATOM | 3870 | N | LEU | B | 142 | 28.481 | 33.778 | 58.936 | 1.00 | 0.00 XXXX 3870 |
| ATOM | 3871 | CA | LEU | B | 142 | 29.085 | 33.303 | 57.696 | 1.00 | 0.00 XXXX 3871 |
| ATOM | 3872 | C | LEU | B | 142 | 30.530 | 32.870 | 57.922 | 1.00 | 0.00 XXXX 3872 |
| ATOM | 3873 | O | LEU | B | 142 | 30.947 | 31.798 | 57.482 | 1.00 | 0.00 XXXX 3873 |
| ATOM | 3874 | CB | LEU | B | 142 | 29.019 | 34.389 | 56.622 | 1.00 | 0.00 XXXX 3874 |
| ATOM | 3875 | CG | LEU | B | 142 | 27.645 | 34.615 | 55.987 | 1.00 | 0.00 XXXX 3875 |
| ATOM | 3876 | CD1 | LEU | B | 142 | 27.671 | 35.819 | 55.058 | 1.00 | 0.00 XXXX 3876 |
| ATOM | 3877 | CD2 | LEU | B | 142 | 27.199 | 33.366 | 55.242 | 1.00 | 0.00 XXXX 3877 |
| ATOM | 3878 | N | PHE | B | 143 | 31.288 | 33.714 | 58.615 | 1.00 | 0.00 XXXX 3878 |
| ATOM | 3879 | CA | PHE | B | 143 | 32.697 | 33.447 | 58.877 | 1.00 | 0.00 XXXX 3879 |
| ATOM | 3880 | C | PHE | B | 143 | 32.878 | 32.211 | 59.753 | 1.00 | 0.00 XXXX 3880 |
| ATOM | 3881 | O | PHE | B | 143 | 33.718 | 31.358 | 59.468 | 1.00 | 0.00 XXXX 3881 |
| ATOM | 3882 | CB | PHE | B | 143 | 33.356 | 34.660 | 59.538 | 1.00 | 0.00 XXXX 3882 |
| ATOM | 3883 | CG | PHE | B | 143 | 34.837 | 34.513 | 59.733 | 1.00 | 0.00 XXXX 3883 |
| ATOM | 3884 | CD1 | PHE | B | 143 | 35.712 | 34.736 | 58.684 | 1.00 | 0.00 XXXX 3884 |
| ATOM | 3885 | CD2 | PHE | B | 143 | 35.354 | 34.151 | 60.966 | 1.00 | 0.00 XXXX 3885 |
| ATOM | 3886 | CE1 | PHE | B | 143 | 37.077 | 34.600 | 58.860 | 1.00 | 0.00 XXXX 3886 |
| ATOM | 3887 | CE2 | PHE | B | 143 | 36.718 | 34.013 | 61.149 | 1.00 | 0.00 XXXX 3887 |
| ATOM | 3888 | CZ | PHE | B | 143 | 37.580 | 34.238 | 60.094 | 1.00 | 0.00 XXXX 3888 |
| ATOM | 3889 | N | ASP | B | 144 | 32.088 | 32.122 | 60.820 | 1.00 | 0.00 XXXX 3889 |
| ATOM | 3890 | CA | ASP | B | 144 | 32.164 | 30.991 | 61.740 | 1.00 | 0.00 XXXX 3890 |
| ATOM | 3891 | C | ASP | B | 144 | 31.722 | 29.689 | 61.080 | 1.00 | 0.00 XXXX 3891 |
| ATOM | 3892 | O | ASP | B | 144 | 31.968 | 28.603 | 61.606 | 1.00 | 0.00 XXXX 3892 |
| ATOM | 3893 | CB | ASP | B | 144 | 31.314 | 31.256 | 62.985 | 1.00 | 0.00 XXXX 3893 |
| ATOM | 3894 | CG | ASP | B | 144 | 31.928 | 32.300 | 63.894 | 1.00 | 0.00 XXXX 3894 |
| ATOM | 3895 | OD1 | ASP | B | 144 | 33.078 | 32.707 | 63.628 | 1.00 | 0.00 XXXX 3895 |
| ATOM | 3896 | OD2 | ASP | B | 144 | 31.268 | 32.710 | 64.870 | 1.00 | 0.00 XXXX 3896 |
| ATOM | 3897 | N | ASN | B | 145 | 31.073 | 29.803 | 59.927 | 1.00 | 0.00 XXXX 3897 |
| ATOM | 3898 | CA | ASN | B | 145 | 30.641 | 28.627 | 59.183 | 1.00 | 0.00 XXXX 3898 |
| ATOM | 3899 | C | ASN | B | 145 | 31.449 | 28.399 | 57.908 | 1.00 | 0.00 XXXX 3899 |
| ATOM | 3900 | O | ASN | B | 145 | 30.962 | 27.791 | 56.955 | 1.00 | 0.00 XXXX 3900 |
| ATOM | 3901 | CB | ASN | B | 145 | 29.152 | 28.735 | 58.851 | 1.00 | 0.00 XXXX 3901 |
| ATOM | 3902 | CG | ASN | B | 145 | 28.270 | 28.450 | 60.051 | 1.00 | 0.00 XXXX 3902 |
| ATOM | 3903 | OD1 | ASN | B | 145 | 27.927 | 27.299 | 60.321 | 1.00 | 0.00 XXXX 3903 |
| ATOM | 3904 | ND2 | ASN | B | 145 | 27.906 | 29.497 | 60.784 | 1.00 | 0.00 XXXX 3904 |
| ATOM | 3905 | N | GLY | B | 146 | 32.683 | 28.892 | 57.895 | 1.00 | 0.00 XXXX 3905 |
| ATOM | 3906 | CA | GLY | B | 146 | 33.633 | 28.533 | 56.858 | 1.00 | 0.00 XXXX 3906 |
| ATOM | 3907 | C | GLY | B | 146 | 33.742 | 29.467 | 55.666 | 1.00 | 0.00 XXXX 3907 |
| ATOM | 3908 | O | GLY | B | 146 | 34.570 | 29.244 | 54.783 | 1.00 | 0.00 XXXX 3908 |
| ATOM | 3909 | N | LYS | B | 147 | 32.919 | 30.510 | 55.630 | 1.00 | 0.00 XXXX 3909 |
| ATOM | 3910 | CA | LYS | B | 147 | 32.981 | 31.469 | 54.530 | 1.00 | 0.00 XXXX 3910 |
| ATOM | 3911 | C | LYS | B | 147 | 34.005 | 32.554 | 54.839 | 1.00 | 0.00 XXXX 3911 |
| ATOM | 3912 | O | LYS | B | 147 | 33.781 | 33.409 | 55.697 | 1.00 | 0.00 XXXX 3912 |
| ATOM | 3913 | CB | LYS | B | 147 | 31.607 | 32.089 | 54.270 | 1.00 | 0.00 XXXX 3913 |
| ATOM | 3914 | CG | LYS | B | 147 | 30.481 | 31.073 | 54.151 | 1.00 | 0.00 XXXX 3914 |
| ATOM | 3915 | CD | LYS | B | 147 | 30.790 | 30.001 | 53.114 | 1.00 | 0.00 XXXX 3915 |
| ATOM | 3916 | CE | LYS | B | 147 | 29.769 | 28.871 | 53.164 | 1.00 | 0.00 XXXX 3916 |
| ATOM | 3917 | NZ | LYS | B | 147 | 30.036 | 27.836 | 52.127 | 1.00 | 0.00 XXXX 3917 |
| ATOM | 3918 | N | LYS | B | 148 | 35.127 | 32.516 | 54.127 | 1.00 | 0.00 XXXX 3918 |
| ATOM | 3919 | CA | LYS | B | 148 | 36.248 | 33.402 | 54.416 | 1.00 | 0.00 XXXX 3919 |
| ATOM | 3920 | C | LYS | B | 148 | 36.470 | 34.437 | 53.319 | 1.00 | 0.00 XXXX 3920 |
| ATOM | 3921 | O | LYS | B | 148 | 36.995 | 35.521 | 53.574 | 1.00 | 0.00 XXXX 3921 |

| | | | | | -continued | | | | | |
|---|---|---|---|---|---|---|---|---|---|---|
| ATOM | 3922 | CB | LYS B | 148 | 37.525 | 32.585 | 54.615 | 1.00 | 0.00 XXXX | 3922 |
| ATOM | 3923 | CG | LYS B | 148 | 37.357 | 31.400 | 55.549 | 1.00 | 0.00 XXXX | 3923 |
| ATOM | 3924 | CD | LYS B | 148 | 36.948 | 31.851 | 56.939 | 1.00 | 0.00 XXXX | 3924 |
| ATOM | 3925 | CE | LYS B | 148 | 36.695 | 30.662 | 57.846 | 1.00 | 0.00 XXXX | 3925 |
| ATOM | 3926 | NZ | LYS B | 148 | 36.427 | 31.080 | 59.248 | 1.00 | 0.00 XXXX | 3926 |
| ATOM | 3927 | N | ARG B | 149 | 36.067 | 34.094 | 52.100 | 1.00 | 0.00 XXXX | 3927 |
| ATOM | 3928 | CA | ARG B | 149 | 36.325 | 34.933 | 50.936 | 1.00 | 0.00 XXXX | 3928 |
| ATOM | 3929 | C | ARG B | 149 | 35.030 | 35.513 | 50.377 | 1.00 | 0.00 XXXX | 3929 |
| ATOM | 3930 | O | ARG B | 149 | 34.277 | 34.829 | 49.685 | 1.00 | 0.00 XXXX | 3930 |
| ATOM | 3931 | CB | ARG B | 149 | 37.059 | 34.133 | 49.859 | 1.00 | 0.00 XXXX | 3931 |
| ATOM | 3932 | CG | ARG B | 149 | 38.384 | 33.549 | 50.326 | 1.00 | 0.00 XXXX | 3932 |
| ATOM | 3933 | CD | ARG B | 149 | 38.876 | 32.470 | 49.376 | 1.00 | 0.00 XXXX | 3933 |
| ATOM | 3934 | NE | ARG B | 149 | 38.977 | 32.970 | 48.010 | 1.00 | 0.00 XXXX | 3934 |
| ATOM | 3935 | CZ | ARG B | 149 | 38.121 | 32.664 | 47.042 | 1.00 | 0.00 XXXX | 3935 |
| ATOM | 3936 | NH1 | ARG B | 149 | 37.098 | 31.856 | 47.291 | 1.00 | 0.00 XXXX | 3936 |
| ATOM | 3937 | NH2 | ARG B | 149 | 38.284 | 33.166 | 45.824 | 1.00 | 0.00 XXXX | 3937 |
| ATOM | 3938 | N | PHE B | 150 | 34.782 | 36.781 | 50.688 | 1.00 | 0.00 XXXX | 3938 |
| ATOM | 3939 | CA | PHE B | 150 | 33.527 | 37.437 | 50.338 | 1.00 | 0.00 XXXX | 3939 |
| ATOM | 3940 | C | PHE B | 150 | 33.587 | 38.141 | 48.989 | 1.00 | 0.00 XXXX | 3940 |
| ATOM | 3941 | O | PHE B | 150 | 34.566 | 38.816 | 48.672 | 1.00 | 0.00 XXXX | 3941 |
| ATOM | 3942 | CB | PHE B | 150 | 33.141 | 38.461 | 51.411 | 1.00 | 0.00 XXXX | 3942 |
| ATOM | 3943 | CG | PHE B | 150 | 32.588 | 37.855 | 52.671 | 1.00 | 0.00 XXXX | 3943 |
| ATOM | 3944 | CD1 | PHE B | 150 | 33.199 | 36.764 | 53.264 | 1.00 | 0.00 XXXX | 3944 |
| ATOM | 3945 | CD2 | PHE B | 150 | 31.455 | 38.387 | 53.265 | 1.00 | 0.00 XXXX | 3945 |
| ATOM | 3946 | CE1 | PHE B | 150 | 32.689 | 36.212 | 54.424 | 1.00 | 0.00 XXXX | 3946 |
| ATOM | 3947 | CE2 | PHE B | 150 | 30.940 | 37.840 | 54.425 | 1.00 | 0.00 XXXX | 3947 |
| ATOM | 3948 | CZ | PHE B | 150 | 31.558 | 36.751 | 55.005 | 1.00 | 0.00 XXXX | 3948 |
| ATOM | 3949 | N | TYR B | 151 | 32.532 | 37.979 | 48.197 | 1.00 | 0.00 XXXX | 3949 |
| ATOM | 3950 | CA | TYR B | 151 | 32.335 | 38.803 | 47.012 | 1.00 | 0.00 XXXX | 3950 |
| ATOM | 3951 | C | TYR B | 151 | 31.178 | 39.756 | 47.281 | 1.00 | 0.00 XXXX | 3951 |
| ATOM | 3952 | O | TYR B | 151 | 30.052 | 39.322 | 47.524 | 1.00 | 0.00 XXXX | 3952 |
| ATOM | 3953 | CB | TYR B | 151 | 32.053 | 37.952 | 45.772 | 1.00 | 0.00 XXXX | 3953 |
| ATOM | 3954 | CG | TYR B | 151 | 32.293 | 38.688 | 44.469 | 1.00 | 0.00 XXXX | 3954 |
| ATOM | 3955 | CD1 | TYR B | 151 | 33.388 | 38.385 | 43.669 | 1.00 | 0.00 XXXX | 3955 |
| ATOM | 3956 | CD2 | TYR B | 151 | 31.434 | 39.695 | 44.048 | 1.00 | 0.00 XXXX | 3956 |
| ATOM | 3957 | CE1 | TYR B | 151 | 33.615 | 39.059 | 42.480 | 1.00 | 0.00 XXXX | 3957 |
| ATOM | 3958 | CE2 | TYR B | 151 | 31.653 | 40.375 | 42.862 | 1.00 | 0.00 XXXX | 3958 |
| ATOM | 3959 | CZ | TYR B | 151 | 32.744 | 40.053 | 42.082 | 1.00 | 0.00 XXXX | 3959 |
| ATOM | 3960 | OH | TYR B | 151 | 32.962 | 40.729 | 40.902 | 1.00 | 0.00 XXXX | 3960 |
| ATOM | 3961 | N | LEU B | 152 | 31.459 | 41.053 | 47.245 | 1.00 | 0.00 XXXX | 3961 |
| ATOM | 3962 | CA | LEU B | 152 | 30.449 | 42.051 | 47.574 | 1.00 | 0.00 XXXX | 3962 |
| ATOM | 3963 | C | LEU B | 152 | 29.756 | 42.595 | 46.330 | 1.00 | 0.00 XXXX | 3963 |
| ATOM | 3964 | O | LEU B | 152 | 30.408 | 43.059 | 45.395 | 1.00 | 0.00 XXXX | 3964 |
| ATOM | 3965 | CB | LEU B | 152 | 31.078 | 43.200 | 48.365 | 1.00 | 0.00 XXXX | 3965 |
| ATOM | 3966 | CG | LEU B | 152 | 31.914 | 42.788 | 49.581 | 1.00 | 0.00 XXXX | 3966 |
| ATOM | 3967 | CD1 | LEU B | 152 | 32.498 | 44.008 | 50.276 | 1.00 | 0.00 XXXX | 3967 |
| ATOM | 3968 | CD2 | LEU B | 152 | 31.088 | 41.954 | 50.551 | 1.00 | 0.00 XXXX | 3968 |
| ATOM | 3969 | N | LEU B | 153 | 28.429 | 42.531 | 46.329 | 1.00 | 0.00 XXXX | 3969 |
| ATOM | 3970 | CA | LEU B | 153 | 27.633 | 43.056 | 45.226 | 1.00 | 0.00 XXXX | 3970 |
| ATOM | 3971 | C | LEU B | 153 | 26.418 | 43.799 | 45.766 | 1.00 | 0.00 XXXX | 3971 |
| ATOM | 3972 | O | LEU B | 153 | 25.623 | 43.238 | 46.521 | 1.00 | 0.00 XXXX | 3972 |
| ATOM | 3973 | CB | LEU B | 153 | 27.193 | 41.932 | 44.287 | 1.00 | 0.00 XXXX | 3973 |
| ATOM | 3974 | CG | LEU B | 153 | 26.175 | 42.322 | 43.212 | 1.00 | 0.00 XXXX | 3974 |
| ATOM | 3975 | CD1 | LEU B | 153 | 26.799 | 43.273 | 42.201 | 1.00 | 0.00 XXXX | 3975 |
| ATOM | 3976 | CD2 | LEU B | 153 | 25.608 | 41.088 | 42.521 | 1.00 | 0.00 XXXX | 3976 |
| ATOM | 3977 | N | GLY B | 154 | 26.277 | 45.061 | 45.377 | 1.00 | 0.00 XXXX | 3977 |
| ATOM | 3978 | CA | GLY B | 154 | 25.167 | 45.876 | 45.834 | 1.00 | 0.00 XXXX | 3978 |
| ATOM | 3979 | C | GLY B | 154 | 24.809 | 46.980 | 44.860 | 1.00 | 0.00 XXXX | 3979 |
| ATOM | 3980 | O | GLY B | 154 | 25.505 | 47.193 | 43.867 | 1.00 | 0.00 XXXX | 3980 |
| ATOM | 3981 | N | SER B | 155 | 23.717 | 47.681 | 45.147 | 1.00 | 0.00 XXXX | 3981 |
| ATOM | 3982 | CA | SER B | 155 | 23.300 | 48.820 | 44.339 | 1.00 | 0.00 XXXX | 3982 |
| ATOM | 3983 | C | SER B | 155 | 24.155 | 50.043 | 44.652 | 1.00 | 0.00 XXXX | 3983 |
| ATOM | 3984 | O | SER B | 155 | 24.662 | 50.189 | 45.763 | 1.00 | 0.00 XXXX | 3984 |
| ATOM | 3985 | CB | SER B | 155 | 21.819 | 49.129 | 44.569 | 1.00 | 0.00 XXXX | 3985 |
| ATOM | 3986 | OG | SER B | 155 | 21.014 | 48.007 | 44.248 | 1.00 | 0.00 XXXX | 3986 |
| ATOM | 3987 | N | ASP B | 156 | 24.318 | 50.917 | 43.665 | 1.00 | 0.00 XXXX | 3987 |
| ATOM | 3988 | CA | ASP B | 156 | 25.236 | 52.043 | 43.792 | 1.00 | 0.00 XXXX | 3988 |
| ATOM | 3989 | C | ASP B | 156 | 24.609 | 53.246 | 44.489 | 1.00 | 0.00 XXXX | 3989 |
| ATOM | 3990 | O | ASP B | 156 | 24.160 | 54.188 | 43.836 | 1.00 | 0.00 XXXX | 3990 |
| ATOM | 3991 | CB | ASP B | 156 | 25.754 | 52.462 | 42.413 | 1.00 | 0.00 XXXX | 3991 |
| ATOM | 3992 | CG | ASP B | 156 | 27.034 | 53.273 | 42.494 | 1.00 | 0.00 XXXX | 3992 |
| ATOM | 3993 | OD1 | ASP B | 156 | 27.417 | 53.676 | 43.613 | 1.00 | 0.00 XXXX | 3993 |
| ATOM | 3994 | OD2 | ASP B | 156 | 27.660 | 53.504 | 41.437 | 1.00 | 0.00 XXXX | 3994 |
| ATOM | 3995 | N | TYR B | 157 | 24.582 | 53.202 | 45.817 | 1.00 | 0.00 XXXX | 3995 |
| ATOM | 3996 | CA | TYR B | 157 | 24.200 | 54.356 | 46.623 | 1.00 | 0.00 XXXX | 3996 |
| ATOM | 3997 | C | TYR B | 157 | 24.678 | 54.146 | 48.058 | 1.00 | 0.00 XXXX | 3997 |
| ATOM | 3998 | O | TYR B | 157 | 25.420 | 53.203 | 48.335 | 1.00 | 0.00 XXXX | 3998 |
| ATOM | 3999 | CB | TYR B | 157 | 22.688 | 54.610 | 46.560 | 1.00 | 0.00 XXXX | 3999 |
| ATOM | 4000 | CG | TYR B | 157 | 21.821 | 53.574 | 47.238 | 1.00 | 0.00 XXXX | 4000 |

-continued

| | | | | | | | | | | |
|---|---|---|---|---|---|---|---|---|---|---|
| ATOM | 4001 | CD1 | TYR B | 157 | 21.260 | 53.820 | 48.484 | 1.00 | 0.00 | XXXX | 4001 |
| ATOM | 4002 | CD2 | TYR B | 157 | 21.550 | 52.357 | 46.626 | 1.00 | 0.00 | XXXX | 4002 |
| ATOM | 4003 | CE1 | TYR B | 157 | 20.458 | 52.880 | 49.106 | 1.00 | 0.00 | XXXX | 4003 |
| ATOM | 4004 | CE2 | TYR B | 157 | 20.752 | 51.410 | 47.241 | 1.00 | 0.00 | XXXX | 4004 |
| ATOM | 4005 | CZ | TYR B | 157 | 20.208 | 51.678 | 48.481 | 1.00 | 0.00 | XXXX | 4005 |
| ATOM | 4006 | OH | TYR B | 157 | 19.413 | 50.739 | 49.098 | 1.00 | 0.00 | XXXX | 4006 |
| ATOM | 4007 | N | VAL B | 158 | 24.256 | 55.015 | 48.969 | 1.00 | 0.00 | XXXX | 4007 |
| ATOM | 4008 | CA | VAL B | 158 | 24.921 | 55.121 | 50.265 | 1.00 | 0.00 | XXXX | 4008 |
| ATOM | 4009 | C | VAL B | 158 | 24.807 | 53.879 | 51.156 | 1.00 | 0.00 | XXXX | 4009 |
| ATOM | 4010 | O | VAL B | 158 | 25.737 | 53.575 | 51.905 | 1.00 | 0.00 | XXXX | 4010 |
| ATOM | 4011 | CB | VAL B | 158 | 24.397 | 56.337 | 51.056 | 1.00 | 0.00 | XXXX | 4011 |
| ATOM | 4012 | CG1 | VAL B | 158 | 22.928 | 56.157 | 51.412 | 1.00 | 0.00 | XXXX | 4012 |
| ATOM | 4013 | CG2 | VAL B | 158 | 25.238 | 56.553 | 52.304 | 1.00 | 0.00 | XXXX | 4013 |
| ATOM | 4014 | N | PHE B | 159 | 23.692 | 53.155 | 51.091 | 1.00 | 0.00 | XXXX | 4014 |
| ATOM | 4015 | CA | PHE B | 159 | 23.550 | 51.990 | 51.964 | 1.00 | 0.00 | XXXX | 4015 |
| ATOM | 4016 | C | PHE B | 159 | 24.546 | 50.881 | 51.624 | 1.00 | 0.00 | XXXX | 4016 |
| ATOM | 4017 | O | PHE B | 159 | 25.331 | 50.472 | 52.478 | 1.00 | 0.00 | XXXX | 4017 |
| ATOM | 4018 | CB | PHE B | 159 | 22.137 | 51.409 | 51.921 | 1.00 | 0.00 | XXXX | 4018 |
| ATOM | 4019 | CG | PHE B | 159 | 22.065 | 50.003 | 52.452 | 1.00 | 0.00 | XXXX | 4019 |
| ATOM | 4020 | CD1 | PHE B | 159 | 22.353 | 49.741 | 53.782 | 1.00 | 0.00 | XXXX | 4020 |
| ATOM | 4021 | CD2 | PHE B | 159 | 21.749 | 48.942 | 51.620 | 1.00 | 0.00 | XXXX | 4021 |
| ATOM | 4022 | CE1 | PHE B | 159 | 22.309 | 48.451 | 54.278 | 1.00 | 0.00 | XXXX | 4022 |
| ATOM | 4023 | CE2 | PHE B | 159 | 21.701 | 47.648 | 52.111 | 1.00 | 0.00 | XXXX | 4023 |
| ATOM | 4024 | CZ | PHE B | 159 | 21.982 | 47.403 | 53.440 | 1.00 | 0.00 | XXXX | 4024 |
| ATOM | 4025 | N | PRO B | 160 | 24.515 | 50.386 | 50.376 | 1.00 | 0.00 | XXXX | 4025 |
| ATOM | 4026 | CA | PRO B | 160 | 25.434 | 49.309 | 49.994 | 1.00 | 0.00 | XXXX | 4026 |
| ATOM | 4027 | C | PRO B | 160 | 26.897 | 49.726 | 50.119 | 1.00 | 0.00 | XXXX | 4027 |
| ATOM | 4028 | O | PRO B | 160 | 27.733 | 48.907 | 50.506 | 1.00 | 0.00 | XXXX | 4028 |
| ATOM | 4029 | CB | PRO B | 160 | 25.059 | 49.034 | 48.536 | 1.00 | 0.00 | XXXX | 4029 |
| ATOM | 4030 | CG | PRO B | 160 | 23.621 | 49.438 | 48.451 | 1.00 | 0.00 | XXXX | 4030 |
| ATOM | 4031 | CD | PRO B | 160 | 23.532 | 50.663 | 49.314 | 1.00 | 0.00 | XXXX | 4031 |
| ATOM | 4032 | N | ARG B | 161 | 27.193 | 50.984 | 49.810 | 1.00 | 0.00 | XXXX | 4032 |
| ATOM | 4033 | CA | ARG B | 161 | 28.555 | 51.495 | 49.920 | 1.00 | 0.00 | XXXX | 4033 |
| ATOM | 4034 | C | ARG B | 161 | 29.019 | 51.489 | 51.372 | 1.00 | 0.00 | XXXX | 4034 |
| ATOM | 4035 | O | ARG B | 161 | 30.129 | 51.056 | 51.677 | 1.00 | 0.00 | XXXX | 4035 |
| ATOM | 4036 | CB | ARG B | 161 | 28.650 | 52.913 | 49.351 | 1.00 | 0.00 | XXXX | 4036 |
| ATOM | 4037 | CG | ARG B | 161 | 28.459 | 53.011 | 47.847 | 1.00 | 0.00 | XXXX | 4037 |
| ATOM | 4038 | CD | ARG B | 161 | 29.758 | 52.730 | 47.114 | 1.00 | 0.00 | XXXX | 4038 |
| ATOM | 4039 | NE | ARG B | 161 | 29.638 | 52.953 | 45.676 | 1.00 | 0.00 | XXXX | 4039 |
| ATOM | 4040 | CZ | ARG B | 161 | 30.654 | 52.875 | 44.823 | 1.00 | 0.00 | XXXX | 4040 |
| ATOM | 4041 | NH1 | ARG B | 161 | 31.870 | 52.585 | 45.264 | 1.00 | 0.00 | XXXX | 4041 |
| ATOM | 4042 | NH2 | ARG B | 161 | 30.456 | 53.092 | 43.530 | 1.00 | 0.00 | XXXX | 4042 |
| ATOM | 4043 | N | THR B | 162 | 28.154 | 51.958 | 52.267 | 1.00 | 0.00 | XXXX | 4043 |
| ATOM | 4044 | CA | THR B | 162 | 28.470 | 52.008 | 53.690 | 1.00 | 0.00 | XXXX | 4044 |
| ATOM | 4045 | C | THR B | 162 | 28.464 | 50.617 | 54.320 | 1.00 | 0.00 | XXXX | 4045 |
| ATOM | 4046 | O | THR B | 162 | 29.307 | 50.302 | 55.163 | 1.00 | 0.00 | XXXX | 4046 |
| ATOM | 4047 | CB | THR B | 162 | 27.481 | 52.907 | 54.450 | 1.00 | 0.00 | XXXX | 4047 |
| ATOM | 4048 | OG1 | THR B | 162 | 27.466 | 54.211 | 53.857 | 1.00 | 0.00 | XXXX | 4048 |
| ATOM | 4049 | CG2 | THR B | 162 | 27.881 | 53.024 | 55.913 | 1.00 | 0.00 | XXXX | 4049 |
| ATOM | 4050 | N | ALA B | 163 | 27.504 | 49.794 | 53.909 | 1.00 | 0.00 | XXXX | 4050 |
| ATOM | 4051 | CA | ALA B | 163 | 27.406 | 48.422 | 54.391 | 1.00 | 0.00 | XXXX | 4051 |
| ATOM | 4052 | C | ALA B | 163 | 28.695 | 47.658 | 54.108 | 1.00 | 0.00 | XXXX | 4052 |
| ATOM | 4053 | O | ALA B | 163 | 29.225 | 46.973 | 54.981 | 1.00 | 0.00 | XXXX | 4053 |
| ATOM | 4054 | CB | ALA B | 163 | 26.216 | 47.720 | 53.752 | 1.00 | 0.00 | XXXX | 4054 |
| ATOM | 4055 | N | ASN B | 164 | 29.202 | 47.796 | 52.888 | 1.00 | 0.00 | XXXX | 4055 |
| ATOM | 4056 | CA | ASN B | 164 | 30.421 | 47.110 | 52.487 | 1.00 | 0.00 | XXXX | 4056 |
| ATOM | 4057 | C | ASN B | 164 | 31.649 | 47.680 | 53.189 | 1.00 | 0.00 | XXXX | 4057 |
| ATOM | 4058 | O | ASN B | 164 | 32.611 | 46.958 | 53.450 | 1.00 | 0.00 | XXXX | 4058 |
| ATOM | 4059 | CB | ASN B | 164 | 30.594 | 47.180 | 50.970 | 1.00 | 0.00 | XXXX | 4059 |
| ATOM | 4060 | CG | ASN B | 164 | 29.601 | 46.300 | 50.236 | 1.00 | 0.00 | XXXX | 4060 |
| ATOM | 4061 | OD1 | ASN B | 164 | 29.076 | 45.341 | 50.802 | 1.00 | 0.00 | XXXX | 4061 |
| ATOM | 4062 | ND2 | ASN B | 164 | 29.336 | 46.621 | 48.975 | 1.00 | 0.00 | XXXX | 4062 |
| ATOM | 4063 | N | LYS B | 165 | 31.616 | 48.975 | 53.491 | 1.00 | 0.00 | XXXX | 4063 |
| ATOM | 4064 | CA | LYS B | 165 | 32.673 | 49.586 | 54.291 | 1.00 | 0.00 | XXXX | 4064 |
| ATOM | 4065 | C | LYS B | 165 | 32.720 | 48.943 | 55.674 | 1.00 | 0.00 | XXXX | 4065 |
| ATOM | 4066 | O | LYS B | 165 | 33.794 | 48.665 | 56.208 | 1.00 | 0.00 | XXXX | 4066 |
| ATOM | 4067 | CB | LYS B | 165 | 32.463 | 51.097 | 54.417 | 1.00 | 0.00 | XXXX | 4067 |
| ATOM | 4068 | CG | LYS B | 165 | 33.557 | 51.799 | 55.212 | 1.00 | 0.00 | XXXX | 4068 |
| ATOM | 4069 | CD | LYS B | 165 | 33.268 | 53.282 | 55.392 | 1.00 | 0.00 | XXXX | 4069 |
| ATOM | 4070 | CE | LYS B | 165 | 34.374 | 53.963 | 56.187 | 1.00 | 0.00 | XXXX | 4070 |
| ATOM | 4071 | NZ | LYS B | 165 | 34.167 | 55.434 | 56.289 | 1.00 | 0.00 | XXXX | 4071 |
| ATOM | 4072 | N | ILE B | 166 | 31.543 | 48.708 | 56.247 | 1.00 | 0.00 | XXXX | 4072 |
| ATOM | 4073 | CA | ILE B | 166 | 31.435 | 48.033 | 57.534 | 1.00 | 0.00 | XXXX | 4073 |
| ATOM | 4074 | C | ILE B | 166 | 31.884 | 46.580 | 57.428 | 1.00 | 0.00 | XXXX | 4074 |
| ATOM | 4075 | O | ILE B | 166 | 32.649 | 46.095 | 58.261 | 1.00 | 0.00 | XXXX | 4075 |
| ATOM | 4076 | CB | ILE B | 166 | 29.994 | 48.071 | 58.076 | 1.00 | 0.00 | XXXX | 4076 |
| ATOM | 4077 | CG1 | ILE B | 166 | 29.591 | 49.505 | 58.417 | 1.00 | 0.00 | XXXX | 4077 |
| ATOM | 4078 | CG2 | ILE B | 166 | 29.865 | 47.181 | 59.302 | 1.00 | 0.00 | XXXX | 4078 |
| ATOM | 4079 | CD1 | ILE B | 166 | 28.117 | 49.664 | 58.717 | 1.00 | 0.00 | XXXX | 4079 |

| | | | | -continued | | | | | | |
|---|---|---|---|---|---|---|---|---|---|---|
| ATOM | 4080 | N | ILE B | 167 | 31.399 | 45.895 | 56.397 | 1.00 | 0.00 XXXX | 4080 |
| ATOM | 4081 | CA | ILE B | 167 | 31.709 | 44.485 | 56.187 | 1.00 | 0.00 XXXX | 4081 |
| ATOM | 4082 | C | ILE B | 167 | 33.210 | 44.245 | 56.044 | 1.00 | 0.00 XXXX | 4082 |
| ATOM | 4083 | O | ILE B | 167 | 33.747 | 43.289 | 56.604 | 1.00 | 0.00 XXXX | 4083 |
| ATOM | 4084 | CB | ILE B | 167 | 30.985 | 43.934 | 54.942 | 1.00 | 0.00 XXXX | 4084 |
| ATOM | 4085 | CG1 | ILE B | 167 | 29.467 | 43.971 | 55.152 | 1.00 | 0.00 XXXX | 4085 |
| ATOM | 4086 | CG2 | ILE B | 167 | 31.445 | 42.517 | 54.637 | 1.00 | 0.00 XXXX | 4086 |
| ATOM | 4087 | CD1 | ILE B | 167 | 28.668 | 43.553 | 53.937 | 1.00 | 0.00 XXXX | 4087 |
| ATOM | 4088 | N | LYS B | 168 | 33.884 | 45.109 | 55.293 | 1.00 | 0.00 XXXX | 4088 |
| ATOM | 4089 | CA | LYS B | 168 | 35.324 | 44.976 | 55.096 | 1.00 | 0.00 XXXX | 4089 |
| ATOM | 4090 | C | LYS B | 168 | 36.098 | 45.195 | 56.393 | 1.00 | 0.00 XXXX | 4090 |
| ATOM | 4091 | O | LYS B | 168 | 37.098 | 44.524 | 56.644 | 1.00 | 0.00 XXXX | 4091 |
| ATOM | 4092 | CB | LYS B | 168 | 35.817 | 45.945 | 54.018 | 1.00 | 0.00 XXXX | 4092 |
| ATOM | 4093 | CG | LYS B | 168 | 35.422 | 45.538 | 52.605 | 1.00 | 0.00 XXXX | 4093 |
| ATOM | 4094 | CD | LYS B | 168 | 36.188 | 46.326 | 51.553 | 1.00 | 0.00 XXXX | 4094 |
| ATOM | 4095 | CE | LYS B | 168 | 35.510 | 47.645 | 51.236 | 1.00 | 0.00 XXXX | 4095 |
| ATOM | 4096 | NZ | LYS B | 168 | 36.093 | 48.282 | 50.020 | 1.00 | 0.00 XXXX | 4096 |
| ATOM | 4097 | N | ALA B | 169 | 35.641 | 46.139 | 57.210 | 1.00 | 0.00 XXXX | 4097 |
| ATOM | 4098 | CA | ALA B | 169 | 36.293 | 46.421 | 58.484 | 1.00 | 0.00 XXXX | 4098 |
| ATOM | 4099 | C | ALA B | 169 | 36.178 | 45.224 | 59.422 | 1.00 | 0.00 XXXX | 4099 |
| ATOM | 4100 | O | ALA B | 169 | 37.123 | 44.884 | 60.135 | 1.00 | 0.00 XXXX | 4100 |
| ATOM | 4101 | CB | ALA B | 169 | 35.695 | 47.665 | 59.127 | 1.00 | 0.00 XXXX | 4101 |
| ATOM | 4102 | N | TYR B | 170 | 35.010 | 44.589 | 59.415 | 1.00 | 0.00 XXXX | 4102 |
| ATOM | 4103 | CA | TYR B | 170 | 34.753 | 43.434 | 60.265 | 1.00 | 0.00 XXXX | 4103 |
| ATOM | 4104 | C | TYR B | 170 | 35.530 | 42.209 | 59.784 | 1.00 | 0.00 XXXX | 4104 |
| ATOM | 4105 | O | TYR B | 170 | 36.123 | 41.487 | 60.587 | 1.00 | 0.00 XXXX | 4105 |
| ATOM | 4106 | CB | TYR B | 170 | 33.255 | 43.126 | 60.305 | 1.00 | 0.00 XXXX | 4106 |
| ATOM | 4107 | CG | TYR B | 170 | 32.833 | 42.253 | 61.467 | 1.00 | 0.00 XXXX | 4107 |
| ATOM | 4108 | CD1 | TYR B | 170 | 33.690 | 42.022 | 62.538 | 1.00 | 0.00 XXXX | 4108 |
| ATOM | 4109 | CD2 | TYR B | 170 | 31.576 | 41.662 | 61.495 | 1.00 | 0.00 XXXX | 4109 |
| ATOM | 4110 | CE1 | TYR B | 170 | 33.304 | 41.226 | 63.605 | 1.00 | 0.00 XXXX | 4110 |
| ATOM | 4111 | CE2 | TYR B | 170 | 31.183 | 40.864 | 62.556 | 1.00 | 0.00 XXXX | 4111 |
| ATOM | 4112 | CZ | TYR B | 170 | 32.049 | 40.649 | 63.607 | 1.00 | 0.00 XXXX | 4112 |
| ATOM | 4113 | OH | TYR B | 170 | 31.655 | 39.855 | 64.661 | 1.00 | 0.00 XXXX | 4113 |
| ATOM | 4114 | N | LEU B | 171 | 35.521 | 41.980 | 58.473 | 1.00 | 0.00 XXXX | 4114 |
| ATOM | 4115 | CA | LEU B | 171 | 36.250 | 40.859 | 57.882 | 1.00 | 0.00 XXXX | 4115 |
| ATOM | 4116 | C | LEU B | 171 | 37.741 | 40.943 | 58.182 | 1.00 | 0.00 XXXX | 4116 |
| ATOM | 4117 | O | LEU B | 171 | 38.383 | 39.929 | 58.450 | 1.00 | 0.00 XXXX | 4117 |
| ATOM | 4118 | CB | LEU B | 171 | 36.023 | 40.797 | 56.370 | 1.00 | 0.00 XXXX | 4118 |
| ATOM | 4119 | CG | LEU B | 171 | 34.759 | 40.069 | 55.908 | 1.00 | 0.00 XXXX | 4119 |
| ATOM | 4120 | CD1 | LEU B | 171 | 34.625 | 40.132 | 54.393 | 1.00 | 0.00 XXXX | 4120 |
| ATOM | 4121 | CD2 | LEU B | 171 | 34.763 | 38.624 | 56.391 | 1.00 | 0.00 XXXX | 4121 |
| ATOM | 4122 | N | LYS B | 172 | 38.289 | 42.153 | 58.127 | 1.00 | 0.00 XXXX | 4122 |
| ATOM | 4123 | CA | LYS B | 172 | 39.687 | 42.371 | 58.478 | 1.00 | 0.00 XXXX | 4123 |
| ATOM | 4124 | C | LYS B | 172 | 39.929 | 41.968 | 59.927 | 1.00 | 0.00 XXXX | 4124 |
| ATOM | 4125 | O | LYS B | 172 | 40.953 | 41.371 | 60.258 | 1.00 | 0.00 XXXX | 4125 |
| ATOM | 4126 | CB | LYS B | 172 | 40.084 | 43.833 | 58.263 | 1.00 | 0.00 XXXX | 4126 |
| ATOM | 4127 | CG | LYS B | 172 | 41.493 | 44.160 | 58.737 | 1.00 | 0.00 XXXX | 4127 |
| ATOM | 4128 | CD | LYS B | 172 | 41.873 | 45.598 | 58.431 | 1.00 | 0.00 XXXX | 4128 |
| ATOM | 4129 | CE | LYS B | 172 | 43.324 | 45.870 | 58.798 | 1.00 | 0.00 XXXX | 4129 |
| ATOM | 4130 | NZ | LYS B | 172 | 43.721 | 47.275 | 58.509 | 1.00 | 0.00 XXXX | 4130 |
| ATOM | 4131 | N | TYR B | 173 | 38.971 | 42.304 | 60.784 | 1.00 | 0.00 XXXX | 4131 |
| ATOM | 4132 | CA | TYR B | 173 | 39.046 | 41.982 | 62.202 | 1.00 | 0.00 XXXX | 4132 |
| ATOM | 4133 | C | TYR B | 173 | 39.011 | 40.473 | 62.435 | 1.00 | 0.00 XXXX | 4133 |
| ATOM | 4134 | O | TYR B | 173 | 39.720 | 39.951 | 63.296 | 1.00 | 0.00 XXXX | 4134 |
| ATOM | 4135 | CB | TYR B | 173 | 37.897 | 42.662 | 62.952 | 1.00 | 0.00 XXXX | 4135 |
| ATOM | 4136 | CG | TYR B | 173 | 37.827 | 42.338 | 64.426 | 1.00 | 0.00 XXXX | 4136 |
| ATOM | 4137 | CD1 | TYR B | 173 | 38.664 | 42.968 | 65.336 | 1.00 | 0.00 XXXX | 4137 |
| ATOM | 4138 | CD2 | TYR B | 173 | 36.913 | 41.410 | 64.910 | 1.00 | 0.00 XXXX | 4138 |
| ATOM | 4139 | CE1 | TYR B | 173 | 38.599 | 42.680 | 66.685 | 1.00 | 0.00 XXXX | 4139 |
| ATOM | 4140 | CE2 | TYR B | 173 | 36.841 | 41.115 | 66.257 | 1.00 | 0.00 XXXX | 4140 |
| ATOM | 4141 | CZ | TYR B | 173 | 37.687 | 41.754 | 67.140 | 1.00 | 0.00 XXXX | 4141 |
| ATOM | 4142 | OH | TYR B | 173 | 37.618 | 41.464 | 68.484 | 1.00 | 0.00 XXXX | 4142 |
| ATOM | 4143 | N | LEU B | 174 | 38.184 | 39.779 | 61.658 | 1.00 | 0.00 XXXX | 4143 |
| ATOM | 4144 | CA | LEU B | 174 | 37.970 | 38.348 | 61.846 | 1.00 | 0.00 XXXX | 4144 |
| ATOM | 4145 | C | LEU B | 174 | 39.070 | 37.500 | 61.215 | 1.00 | 0.00 XXXX | 4145 |
| ATOM | 4146 | O | LEU B | 174 | 39.397 | 36.424 | 61.715 | 1.00 | 0.00 XXXX | 4146 |
| ATOM | 4147 | CB | LEU B | 174 | 36.611 | 37.939 | 61.273 | 1.00 | 0.00 XXXX | 4147 |
| ATOM | 4148 | CG | LEU B | 174 | 35.380 | 38.489 | 61.998 | 1.00 | 0.00 XXXX | 4148 |
| ATOM | 4149 | CD1 | LEU B | 174 | 34.119 | 38.243 | 61.180 | 1.00 | 0.00 XXXX | 4149 |
| ATOM | 4150 | CD2 | LEU B | 174 | 35.251 | 37.884 | 63.390 | 1.00 | 0.00 XXXX | 4150 |
| ATOM | 4151 | N | GLY B | 175 | 39.639 | 37.989 | 60.118 | 1.00 | 0.00 XXXX | 4151 |
| ATOM | 4152 | CA | GLY B | 175 | 40.666 | 37.253 | 59.405 | 1.00 | 0.00 XXXX | 4152 |
| ATOM | 4153 | C | GLY B | 175 | 40.197 | 36.748 | 58.053 | 1.00 | 0.00 XXXX | 4153 |
| ATOM | 4154 | O | GLY B | 175 | 40.822 | 35.873 | 57.456 | 1.00 | 0.00 XXXX | 4154 |
| ATOM | 4155 | N | GLY B | 176 | 39.090 | 37.304 | 57.571 | 1.00 | 0.00 XXXX | 4155 |
| ATOM | 4156 | CA | GLY B | 176 | 38.590 | 36.992 | 56.244 | 1.00 | 0.00 XXXX | 4156 |
| ATOM | 4157 | C | GLY B | 176 | 38.999 | 38.067 | 55.258 | 1.00 | 0.00 XXXX | 4157 |
| ATOM | 4158 | O | GLY B | 176 | 39.588 | 39.076 | 55.646 | 1.00 | 0.00 XXXX | 4158 |

-continued

| | | | | | | | | | | |
|---|---|---|---|---|---|---|---|---|---|---|
| ATOM | 4159 | N | VAL B | 177 | 38.694 | 37.860 | 53.981 | 1.00 | 0.00 | XXXX | 4159 |
| ATOM | 4160 | CA | VAL B | 177 | 39.044 | 38.844 | 52.963 | 1.00 | 0.00 | XXXX | 4160 |
| ATOM | 4161 | C | VAL B | 177 | 37.922 | 39.055 | 51.955 | 1.00 | 0.00 | XXXX | 4161 |
| ATOM | 4162 | O | VAL B | 177 | 37.036 | 38.212 | 51.802 | 1.00 | 0.00 | XXXX | 4162 |
| ATOM | 4163 | CB | VAL B | 177 | 40.313 | 38.435 | 52.194 | 1.00 | 0.00 | XXXX | 4163 |
| ATOM | 4164 | CG1 | VAL B | 177 | 41.526 | 38.450 | 53.116 | 1.00 | 0.00 | XXXX | 4164 |
| ATOM | 4165 | CG2 | VAL B | 177 | 40.129 | 37.064 | 51.565 | 1.00 | 0.00 | XXXX | 4165 |
| ATOM | 4166 | N | VAL B | 178 | 37.969 | 40.193 | 51.273 | 1.00 | 0.00 | XXXX | 4166 |
| ATOM | 4167 | CA | VAL B | 178 | 37.061 | 40.469 | 50.171 | 1.00 | 0.00 | XXXX | 4167 |
| ATOM | 4168 | C | VAL B | 178 | 37.818 | 40.233 | 48.873 | 1.00 | 0.00 | XXXX | 4168 |
| ATOM | 4169 | O | VAL B | 178 | 38.887 | 40.805 | 48.659 | 1.00 | 0.00 | XXXX | 4169 |
| ATOM | 4170 | CB | VAL B | 178 | 36.523 | 41.908 | 50.218 | 1.00 | 0.00 | XXXX | 4170 |
| ATOM | 4171 | CG1 | VAL B | 178 | 35.739 | 42.223 | 48.953 | 1.00 | 0.00 | XXXX | 4171 |
| ATOM | 4172 | CG2 | VAL B | 178 | 35.657 | 42.108 | 51.453 | 1.00 | 0.00 | XXXX | 4172 |
| ATOM | 4173 | N | VAL B | 179 | 37.267 | 39.388 | 48.009 | 1.00 | 0.00 | XXXX | 4173 |
| ATOM | 4174 | CA | VAL B | 179 | 37.940 | 39.029 | 46.765 | 1.00 | 0.00 | XXXX | 4174 |
| ATOM | 4175 | C | VAL B | 179 | 37.249 | 39.658 | 45.563 | 1.00 | 0.00 | XXXX | 4175 |
| ATOM | 4176 | O | VAL B | 179 | 37.622 | 39.406 | 44.417 | 1.00 | 0.00 | XXXX | 4176 |
| ATOM | 4177 | CB | VAL B | 179 | 38.002 | 37.501 | 46.577 | 1.00 | 0.00 | XXXX | 4177 |
| ATOM | 4178 | CG1 | VAL B | 179 | 38.879 | 36.870 | 47.653 | 1.00 | 0.00 | XXXX | 4178 |
| ATOM | 4179 | CG2 | VAL B | 179 | 36.602 | 36.901 | 46.589 | 1.00 | 0.00 | XXXX | 4179 |
| ATOM | 4180 | N | GLY B | 180 | 36.240 | 40.478 | 45.833 | 1.00 | 0.00 | XXXX | 4180 |
| ATOM | 4181 | CA | GLY B | 180 | 35.530 | 41.183 | 44.785 | 1.00 | 0.00 | XXXX | 4181 |
| ATOM | 4182 | C | GLY B | 180 | 34.512 | 42.157 | 45.344 | 1.00 | 0.00 | XXXX | 4182 |
| ATOM | 4183 | O | GLY B | 180 | 33.933 | 41.930 | 46.406 | 1.00 | 0.00 | XXXX | 4183 |
| ATOM | 4184 | N | GLU B | 181 | 34.293 | 43.247 | 44.619 | 1.00 | 0.00 | XXXX | 4184 |
| ATOM | 4185 | CA | GLU B | 181 | 33.359 | 44.280 | 45.045 | 1.00 | 0.00 | XXXX | 4185 |
| ATOM | 4186 | C | GLU B | 181 | 32.831 | 45.034 | 43.834 | 1.00 | 0.00 | XXXX | 4186 |
| ATOM | 4187 | O | GLU B | 181 | 33.591 | 45.687 | 43.121 | 1.00 | 0.00 | XXXX | 4187 |
| ATOM | 4188 | CB | GLU B | 181 | 34.028 | 45.250 | 46.023 | 1.00 | 0.00 | XXXX | 4188 |
| ATOM | 4189 | CG | GLU B | 181 | 33.125 | 46.386 | 46.478 | 1.00 | 0.00 | XXXX | 4189 |
| ATOM | 4190 | CD | GLU B | 181 | 33.815 | 47.335 | 47.438 | 1.00 | 0.00 | XXXX | 4190 |
| ATOM | 4191 | OE1 | GLU B | 181 | 33.141 | 48.247 | 47.961 | 1.00 | 0.00 | XXXX | 4191 |
| ATOM | 4192 | OE2 | GLU B | 181 | 35.030 | 47.167 | 47.672 | 1.00 | 0.00 | XXXX | 4192 |
| ATOM | 4193 | N | GLU B | 182 | 31.526 | 44.946 | 43.606 | 1.00 | 0.00 | XXXX | 4193 |
| ATOM | 4194 | CA | GLU B | 182 | 30.923 | 45.577 | 42.440 | 1.00 | 0.00 | XXXX | 4194 |
| ATOM | 4195 | C | GLU B | 182 | 29.607 | 46.254 | 42.789 | 1.00 | 0.00 | XXXX | 4195 |
| ATOM | 4196 | O | GLU B | 182 | 28.845 | 45.763 | 43.623 | 1.00 | 0.00 | XXXX | 4196 |
| ATOM | 4197 | CB | GLU B | 182 | 30.700 | 44.548 | 41.330 | 1.00 | 0.00 | XXXX | 4197 |
| ATOM | 4198 | CG | GLU B | 182 | 31.974 | 43.906 | 40.812 | 1.00 | 0.00 | XXXX | 4198 |
| ATOM | 4199 | CD | GLU B | 182 | 32.809 | 44.864 | 39.989 | 1.00 | 0.00 | XXXX | 4199 |
| ATOM | 4200 | OE1 | GLU B | 182 | 32.219 | 45.703 | 39.275 | 1.00 | 0.00 | XXXX | 4200 |
| ATOM | 4201 | OE2 | GLU B | 182 | 34.053 | 44.780 | 40.057 | 1.00 | 0.00 | XXXX | 4201 |
| ATOM | 4202 | N | TYR B | 183 | 29.348 | 47.387 | 42.145 | 1.00 | 0.00 | XXXX | 4202 |
| ATOM | 4203 | CA | TYR B | 183 | 28.094 | 48.105 | 42.324 | 1.00 | 0.00 | XXXX | 4203 |
| ATOM | 4204 | C | TYR B | 183 | 27.397 | 48.323 | 40.987 | 1.00 | 0.00 | XXXX | 4204 |
| ATOM | 4205 | O | TYR B | 183 | 28.043 | 48.579 | 39.971 | 1.00 | 0.00 | XXXX | 4205 |
| ATOM | 4206 | CB | TYR B | 183 | 28.340 | 49.447 | 43.018 | 1.00 | 0.00 | XXXX | 4206 |
| ATOM | 4207 | CG | TYR B | 183 | 28.980 | 49.309 | 44.380 | 1.00 | 0.00 | XXXX | 4207 |
| ATOM | 4208 | CD1 | TYR B | 183 | 28.204 | 49.151 | 45.521 | 1.00 | 0.00 | XXXX | 4208 |
| ATOM | 4209 | CD2 | TYR B | 183 | 30.361 | 49.325 | 44.524 | 1.00 | 0.00 | XXXX | 4209 |
| ATOM | 4210 | CE1 | TYR B | 183 | 28.787 | 49.022 | 46.769 | 1.00 | 0.00 | XXXX | 4210 |
| ATOM | 4211 | CE2 | TYR B | 183 | 30.952 | 49.196 | 45.765 | 1.00 | 0.00 | XXXX | 4211 |
| ATOM | 4212 | CZ | TYR B | 183 | 30.161 | 49.044 | 46.884 | 1.00 | 0.00 | XXXX | 4212 |
| ATOM | 4213 | OH | TYR B | 183 | 30.748 | 48.913 | 48.122 | 1.00 | 0.00 | XXXX | 4213 |
| ATOM | 4214 | N | THR B | 184 | 26.074 | 48.217 | 40.994 | 1.00 | 0.00 | XXXX | 4214 |
| ATOM | 4215 | CA | THR B | 184 | 25.274 | 48.536 | 39.822 | 1.00 | 0.00 | XXXX | 4215 |
| ATOM | 4216 | C | THR B | 184 | 24.246 | 49.595 | 40.193 | 1.00 | 0.00 | XXXX | 4216 |
| ATOM | 4217 | O | THR B | 184 | 23.752 | 49.610 | 41.320 | 1.00 | 0.00 | XXXX | 4217 |
| ATOM | 4218 | CB | THR B | 184 | 24.558 | 47.293 | 39.258 | 1.00 | 0.00 | XXXX | 4218 |
| ATOM | 4219 | OG1 | THR B | 184 | 23.735 | 46.711 | 40.276 | 1.00 | 0.00 | XXXX | 4219 |
| ATOM | 4220 | CG2 | THR B | 184 | 25.570 | 46.263 | 38.776 | 1.00 | 0.00 | XXXX | 4220 |
| ATOM | 4221 | N | PRO B | 185 | 23.932 | 50.495 | 39.251 | 1.00 | 0.00 | XXXX | 4221 |
| ATOM | 4222 | CA | PRO B | 185 | 22.896 | 51.504 | 39.491 | 1.00 | 0.00 | XXXX | 4222 |
| ATOM | 4223 | C | PRO B | 185 | 21.576 | 50.852 | 39.886 | 1.00 | 0.00 | XXXX | 4223 |
| ATOM | 4224 | O | PRO B | 185 | 21.277 | 49.757 | 39.405 | 1.00 | 0.00 | XXXX | 4224 |
| ATOM | 4225 | CB | PRO B | 185 | 22.775 | 52.214 | 38.139 | 1.00 | 0.00 | XXXX | 4225 |
| ATOM | 4226 | CG | PRO B | 185 | 24.098 | 51.997 | 37.481 | 1.00 | 0.00 | XXXX | 4226 |
| ATOM | 4227 | CD | PRO B | 185 | 24.535 | 50.628 | 37.913 | 1.00 | 0.00 | XXXX | 4227 |
| ATOM | 4228 | N | LEU B | 186 | 20.818 | 51.495 | 40.768 | 1.00 | 0.00 | XXXX | 4228 |
| ATOM | 4229 | CA | LEU B | 186 | 19.474 | 51.033 | 41.087 | 1.00 | 0.00 | XXXX | 4229 |
| ATOM | 4230 | C | LEU B | 186 | 18.684 | 50.850 | 39.797 | 1.00 | 0.00 | XXXX | 4230 |
| ATOM | 4231 | O | LEU B | 186 | 18.676 | 51.734 | 38.941 | 1.00 | 0.00 | XXXX | 4231 |
| ATOM | 4232 | CB | LEU B | 186 | 18.768 | 52.024 | 42.016 | 1.00 | 0.00 | XXXX | 4232 |
| ATOM | 4233 | CG | LEU B | 186 | 19.090 | 51.920 | 43.510 | 1.00 | 0.00 | XXXX | 4233 |
| ATOM | 4234 | CD1 | LEU B | 186 | 18.592 | 53.146 | 44.253 | 1.00 | 0.00 | XXXX | 4234 |
| ATOM | 4235 | CD2 | LEU B | 186 | 18.486 | 50.657 | 44.105 | 1.00 | 0.00 | XXXX | 4235 |
| ATOM | 4236 | N | GLY B | 187 | 18.024 | 49.704 | 39.660 | 1.00 | 0.00 | XXXX | 4236 |
| ATOM | 4237 | CA | GLY B | 187 | 17.217 | 49.425 | 38.485 | 1.00 | 0.00 | XXXX | 4237 |

-continued

| | | | | | | | | | | |
|---|---|---|---|---|---|---|---|---|---|---|
| ATOM | 4238 | C | GLY B | 187 | 17.966 | 48.713 | 37.371 | 1.00 | 0.00 | XXXX | 4238 |
| ATOM | 4239 | O | GLY B | 187 | 17.370 | 48.331 | 36.364 | 1.00 | 0.00 | XXXX | 4239 |
| ATOM | 4240 | N | HIS B | 188 | 19.275 | 48.552 | 37.544 | 1.00 | 0.00 | XXXX | 4240 |
| ATOM | 4241 | CA | HIS B | 188 | 20.108 | 47.807 | 36.600 | 1.00 | 0.00 | XXXX | 4241 |
| ATOM | 4242 | C | HIS B | 188 | 19.570 | 46.390 | 36.390 | 1.00 | 0.00 | XXXX | 4242 |
| ATOM | 4243 | O | HIS B | 188 | 19.054 | 45.778 | 37.324 | 1.00 | 0.00 | XXXX | 4243 |
| ATOM | 4244 | CB | HIS B | 188 | 21.553 | 47.758 | 37.103 | 1.00 | 0.00 | XXXX | 4244 |
| ATOM | 4245 | CG | HIS B | 188 | 22.556 | 47.412 | 36.046 | 1.00 | 0.00 | XXXX | 4245 |
| ATOM | 4246 | ND1 | HIS B | 188 | 23.013 | 48.331 | 35.126 | 1.00 | 0.00 | XXXX | 4246 |
| ATOM | 4247 | CD2 | HIS B | 188 | 23.195 | 46.251 | 35.768 | 1.00 | 0.00 | XXXX | 4247 |
| ATOM | 4248 | CE1 | HIS B | 188 | 23.889 | 47.750 | 34.325 | 1.00 | 0.00 | XXXX | 4248 |
| ATOM | 4249 | NE2 | HIS B | 188 | 24.017 | 46.488 | 34.693 | 1.00 | 0.00 | XXXX | 4249 |
| ATOM | 4250 | N | THR B | 189 | 19.684 | 45.868 | 35.170 | 1.00 | 0.00 | XXXX | 4250 |
| ATOM | 4251 | CA | THR B | 189 | 19.148 | 44.539 | 34.875 | 1.00 | 0.00 | XXXX | 4251 |
| ATOM | 4252 | C | THR B | 189 | 20.137 | 43.593 | 34.187 | 1.00 | 0.00 | XXXX | 4252 |
| ATOM | 4253 | O | THR B | 189 | 19.871 | 42.397 | 34.075 | 1.00 | 0.00 | XXXX | 4253 |
| ATOM | 4254 | CB | THR B | 189 | 17.885 | 44.632 | 33.993 | 1.00 | 0.00 | XXXX | 4254 |
| ATOM | 4255 | OG1 | THR B | 189 | 18.220 | 45.219 | 32.730 | 1.00 | 0.00 | XXXX | 4255 |
| ATOM | 4256 | CG2 | THR B | 189 | 16.817 | 45.472 | 34.676 | 1.00 | 0.00 | XXXX | 4256 |
| ATOM | 4257 | N | ASP B | 190 | 21.267 | 44.118 | 33.723 | 1.00 | 0.00 | XXXX | 4257 |
| ATOM | 4258 | CA | ASP B | 190 | 22.258 | 43.288 | 33.036 | 1.00 | 0.00 | XXXX | 4258 |
| ATOM | 4259 | C | ASP B | 190 | 23.388 | 42.885 | 33.983 | 1.00 | 0.00 | XXXX | 4259 |
| ATOM | 4260 | O | ASP B | 190 | 24.288 | 43.678 | 34.264 | 1.00 | 0.00 | XXXX | 4260 |
| ATOM | 4261 | CB | ASP B | 190 | 22.827 | 44.026 | 31.820 | 1.00 | 0.00 | XXXX | 4261 |
| ATOM | 4262 | CG | ASP B | 190 | 23.676 | 43.129 | 30.930 | 1.00 | 0.00 | XXXX | 4262 |
| ATOM | 4263 | OD1 | ASP B | 190 | 23.901 | 41.954 | 31.294 | 1.00 | 0.00 | XXXX | 4263 |
| ATOM | 4264 | OD2 | ASP B | 190 | 24.129 | 43.605 | 29.867 | 1.00 | 0.00 | XXXX | 4264 |
| ATOM | 4265 | N | TYR B | 191 | 23.337 | 41.648 | 34.472 | 1.00 | 0.00 | XXXX | 4265 |
| ATOM | 4266 | CA | TYR B | 191 | 24.323 | 41.170 | 35.437 | 1.00 | 0.00 | XXXX | 4266 |
| ATOM | 4267 | C | TYR B | 191 | 25.256 | 40.090 | 34.890 | 1.00 | 0.00 | XXXX | 4267 |
| ATOM | 4268 | O | TYR B | 191 | 25.925 | 39.396 | 35.655 | 1.00 | 0.00 | XXXX | 4268 |
| ATOM | 4269 | CB | TYR B | 191 | 23.608 | 40.669 | 36.693 | 1.00 | 0.00 | XXXX | 4269 |
| ATOM | 4270 | CG | TYR B | 191 | 23.078 | 41.814 | 37.519 | 1.00 | 0.00 | XXXX | 4270 |
| ATOM | 4271 | CD1 | TYR B | 191 | 23.873 | 42.426 | 38.478 | 1.00 | 0.00 | XXXX | 4271 |
| ATOM | 4272 | CD2 | TYR B | 191 | 21.799 | 42.312 | 37.310 | 1.00 | 0.00 | XXXX | 4272 |
| ATOM | 4273 | CE1 | TYR B | 191 | 23.403 | 43.488 | 39.222 | 1.00 | 0.00 | XXXX | 4273 |
| ATOM | 4274 | CE2 | TYR B | 191 | 21.318 | 43.373 | 38.049 | 1.00 | 0.00 | XXXX | 4274 |
| ATOM | 4275 | CZ | TYR B | 191 | 22.125 | 43.957 | 39.004 | 1.00 | 0.00 | XXXX | 4275 |
| ATOM | 4276 | OH | TYR B | 191 | 21.656 | 45.015 | 39.743 | 1.00 | 0.00 | XXXX | 4276 |
| ATOM | 4277 | N | SER B | 192 | 25.299 | 39.949 | 33.569 | 1.00 | 0.00 | XXXX | 4277 |
| ATOM | 4278 | CA | SER B | 192 | 26.187 | 38.979 | 32.938 | 1.00 | 0.00 | XXXX | 4278 |
| ATOM | 4279 | C | SER B | 192 | 27.649 | 39.292 | 33.257 | 1.00 | 0.00 | XXXX | 4279 |
| ATOM | 4280 | O | SER B | 192 | 28.447 | 38.391 | 33.520 | 1.00 | 0.00 | XXXX | 4280 |
| ATOM | 4281 | CB | SER B | 192 | 25.973 | 38.959 | 31.427 | 1.00 | 0.00 | XXXX | 4281 |
| ATOM | 4282 | OG | SER B | 192 | 26.260 | 40.228 | 30.874 | 1.00 | 0.00 | XXXX | 4282 |
| ATOM | 4283 | N | SER B | 193 | 27.991 | 40.576 | 33.228 | 1.00 | 0.00 | XXXX | 4283 |
| ATOM | 4284 | CA | SER B | 193 | 29.356 | 41.017 | 33.497 | 1.00 | 0.00 | XXXX | 4284 |
| ATOM | 4285 | C | SER B | 193 | 29.766 | 40.717 | 34.937 | 1.00 | 0.00 | XXXX | 4285 |
| ATOM | 4286 | O | SER B | 193 | 30.832 | 40.152 | 35.181 | 1.00 | 0.00 | XXXX | 4286 |
| ATOM | 4287 | CB | SER B | 193 | 29.498 | 42.511 | 33.211 | 1.00 | 0.00 | XXXX | 4287 |
| ATOM | 4288 | OG | SER B | 193 | 30.733 | 43.007 | 33.699 | 1.00 | 0.00 | XXXX | 4288 |
| ATOM | 4289 | N | VAL B | 194 | 28.916 | 41.102 | 35.886 | 1.00 | 0.00 | XXXX | 4289 |
| ATOM | 4290 | CA | VAL B | 194 | 29.146 | 40.798 | 37.295 | 1.00 | 0.00 | XXXX | 4290 |
| ATOM | 4291 | C | VAL B | 194 | 29.256 | 39.294 | 37.530 | 1.00 | 0.00 | XXXX | 4291 |
| ATOM | 4292 | O | VAL B | 194 | 30.157 | 38.829 | 38.227 | 1.00 | 0.00 | XXXX | 4292 |
| ATOM | 4293 | CB | VAL B | 194 | 28.024 | 41.361 | 38.188 | 1.00 | 0.00 | XXXX | 4293 |
| ATOM | 4294 | CG1 | VAL B | 194 | 28.072 | 40.719 | 39.569 | 1.00 | 0.00 | XXXX | 4294 |
| ATOM | 4295 | CG2 | VAL B | 194 | 28.128 | 42.875 | 38.284 | 1.00 | 0.00 | XXXX | 4295 |
| ATOM | 4296 | N | ILE B | 195 | 28.329 | 38.540 | 36.948 | 1.00 | 0.00 | XXXX | 4296 |
| ATOM | 4297 | CA | ILE B | 195 | 28.296 | 37.092 | 37.128 | 1.00 | 0.00 | XXXX | 4297 |
| ATOM | 4298 | C | ILE B | 195 | 29.533 | 36.416 | 36.535 | 1.00 | 0.00 | XXXX | 4298 |
| ATOM | 4299 | O | ILE B | 195 | 30.054 | 35.455 | 37.103 | 1.00 | 0.00 | XXXX | 4299 |
| ATOM | 4300 | CB | ILE B | 195 | 27.025 | 36.483 | 36.505 | 1.00 | 0.00 | XXXX | 4300 |
| ATOM | 4301 | CG1 | ILE B | 195 | 25.798 | 36.864 | 37.339 | 1.00 | 0.00 | XXXX | 4301 |
| ATOM | 4302 | CD1 | ILE B | 195 | 24.475 | 36.586 | 36.653 | 1.00 | 0.00 | XXXX | 4302 |
| ATOM | 4303 | CG2 | ILE B | 195 | 27.149 | 34.972 | 36.415 | 1.00 | 0.00 | XXXX | 4303 |
| ATOM | 4304 | N | ASN B | 196 | 29.999 | 36.915 | 35.396 | 1.00 | 0.00 | XXXX | 4304 |
| ATOM | 4305 | CA | ASN B | 196 | 31.238 | 36.412 | 34.811 | 1.00 | 0.00 | XXXX | 4305 |
| ATOM | 4306 | C | ASN B | 196 | 32.431 | 36.666 | 35.727 | 1.00 | 0.00 | XXXX | 4306 |
| ATOM | 4307 | O | ASN B | 196 | 33.326 | 35.828 | 35.837 | 1.00 | 0.00 | XXXX | 4307 |
| ATOM | 4308 | CB | ASN B | 196 | 31.486 | 37.038 | 33.438 | 1.00 | 0.00 | XXXX | 4308 |
| ATOM | 4309 | CG | ASN B | 196 | 30.661 | 36.389 | 32.345 | 1.00 | 0.00 | XXXX | 4309 |
| ATOM | 4310 | OD1 | ASN B | 196 | 30.192 | 35.260 | 32.492 | 1.00 | 0.00 | XXXX | 4310 |
| ATOM | 4311 | ND2 | ASN B | 196 | 30.488 | 37.097 | 31.236 | 1.00 | 0.00 | XXXX | 4311 |
| ATOM | 4312 | N | LYS B | 197 | 32.444 | 37.827 | 36.377 | 1.00 | 0.00 | XXXX | 4312 |
| ATOM | 4313 | CA | LYS B | 197 | 33.498 | 38.153 | 37.334 | 1.00 | 0.00 | XXXX | 4313 |
| ATOM | 4314 | C | LYS B | 197 | 33.442 | 37.235 | 38.550 | 1.00 | 0.00 | XXXX | 4314 |
| ATOM | 4315 | O | LYS B | 197 | 34.472 | 36.774 | 39.040 | 1.00 | 0.00 | XXXX | 4315 |
| ATOM | 4316 | CB | LYS B | 197 | 33.396 | 39.612 | 37.787 | 1.00 | 0.00 | XXXX | 4316 |

-continued

| | | | | | | | | | | |
|---|---|---|---|---|---|---|---|---|---|---|
| ATOM | 4317 | CG | LYS B | 197 | 33.749 | 40.632 | 36.720 | 1.00 | 0.00 | XXXX | 4317 |
| ATOM | 4318 | CD | LYS B | 197 | 33.550 | 42.049 | 37.235 | 1.00 | 0.00 | XXXX | 4318 |
| ATOM | 4319 | CE | LYS B | 197 | 33.860 | 43.078 | 36.161 | 1.00 | 0.00 | XXXX | 4319 |
| ATOM | 4320 | NZ | LYS B | 197 | 33.538 | 44.458 | 36.617 | 1.00 | 0.00 | XXXX | 4320 |
| ATOM | 4321 | N | ILE B | 198 | 32.233 | 36.980 | 39.037 | 1.00 | 0.00 | XXXX | 4321 |
| ATOM | 4322 | CA | ILE B | 198 | 32.040 | 36.074 | 40.161 | 1.00 | 0.00 | XXXX | 4322 |
| ATOM | 4323 | C | ILE B | 198 | 32.532 | 34.667 | 39.821 | 1.00 | 0.00 | XXXX | 4323 |
| ATOM | 4324 | O | ILE B | 198 | 33.192 | 34.020 | 40.635 | 1.00 | 0.00 | XXXX | 4324 |
| ATOM | 4325 | CB | ILE B | 198 | 30.565 | 36.017 | 40.594 | 1.00 | 0.00 | XXXX | 4325 |
| ATOM | 4326 | CG1 | ILE B | 198 | 30.151 | 37.346 | 41.234 | 1.00 | 0.00 | XXXX | 4326 |
| ATOM | 4327 | CG2 | ILE B | 198 | 30.345 | 34.875 | 41.569 | 1.00 | 0.00 | XXXX | 4327 |
| ATOM | 4328 | CD1 | ILE B | 198 | 28.688 | 37.410 | 41.627 | 1.00 | 0.00 | XXXX | 4328 |
| ATOM | 4329 | N | LYS B | 199 | 32.199 | 34.198 | 38.621 | 1.00 | 0.00 | XXXX | 4329 |
| ATOM | 4330 | CA | LYS B | 199 | 32.661 | 32.895 | 38.153 | 1.00 | 0.00 | XXXX | 4330 |
| ATOM | 4331 | C | LYS B | 199 | 34.184 | 32.792 | 38.156 | 1.00 | 0.00 | XXXX | 4331 |
| ATOM | 4332 | O | LYS B | 199 | 34.741 | 31.742 | 38.476 | 1.00 | 0.00 | XXXX | 4332 |
| ATOM | 4333 | CB | LYS B | 199 | 32.131 | 32.604 | 36.745 | 1.00 | 0.00 | XXXX | 4333 |
| ATOM | 4334 | CG | LYS B | 199 | 30.676 | 32.169 | 36.697 | 1.00 | 0.00 | XXXX | 4334 |
| ATOM | 4335 | CD | LYS B | 199 | 30.263 | 31.796 | 35.281 | 1.00 | 0.00 | XXXX | 4335 |
| ATOM | 4336 | CE | LYS B | 199 | 28.826 | 31.308 | 35.235 | 1.00 | 0.00 | XXXX | 4336 |
| ATOM | 4337 | NZ | LYS B | 199 | 28.444 | 30.838 | 33.877 | 1.00 | 0.00 | XXXX | 4337 |
| ATOM | 4338 | N | ALA B | 200 | 34.854 | 33.883 | 37.796 | 1.00 | 0.00 | XXXX | 4338 |
| ATOM | 4339 | CA | ALA B | 200 | 36.311 | 33.891 | 37.726 | 1.00 | 0.00 | XXXX | 4339 |
| ATOM | 4340 | C | ALA B | 200 | 36.950 | 34.003 | 39.108 | 1.00 | 0.00 | XXXX | 4340 |
| ATOM | 4341 | O | ALA B | 200 | 37.987 | 33.395 | 39.371 | 1.00 | 0.00 | XXXX | 4341 |
| ATOM | 4342 | CB | ALA B | 200 | 36.788 | 35.028 | 36.832 | 1.00 | 0.00 | XXXX | 4342 |
| ATOM | 4343 | N | ALA B | 201 | 36.324 | 34.773 | 39.991 | 1.00 | 0.00 | XXXX | 4343 |
| ATOM | 4344 | CA | ALA B | 201 | 36.886 | 35.023 | 41.314 | 1.00 | 0.00 | XXXX | 4344 |
| ATOM | 4345 | C | ALA B | 201 | 36.693 | 33.825 | 42.239 | 1.00 | 0.00 | XXXX | 4345 |
| ATOM | 4346 | O | ALA B | 201 | 37.501 | 33.592 | 43.137 | 1.00 | 0.00 | XXXX | 4346 |
| ATOM | 4347 | CB | ALA B | 201 | 36.264 | 36.271 | 41.926 | 1.00 | 0.00 | XXXX | 4347 |
| ATOM | 4348 | N | LYS B | 202 | 35.626 | 33.066 | 42.004 | 1.00 | 0.00 | XXXX | 4348 |
| ATOM | 4349 | CA | LYS B | 202 | 35.302 | 31.893 | 42.814 | 1.00 | 0.00 | XXXX | 4349 |
| ATOM | 4350 | C | LYS B | 202 | 35.297 | 32.177 | 44.317 | 1.00 | 0.00 | XXXX | 4350 |
| ATOM | 4351 | O | LYS B | 202 | 36.047 | 31.558 | 45.071 | 1.00 | 0.00 | XXXX | 4351 |
| ATOM | 4352 | CB | LYS B | 202 | 36.280 | 30.757 | 42.508 | 1.00 | 0.00 | XXXX | 4352 |
| ATOM | 4353 | CG | LYS B | 202 | 36.200 | 30.240 | 41.080 | 1.00 | 0.00 | XXXX | 4353 |
| ATOM | 4354 | CD | LYS B | 202 | 37.193 | 29.114 | 40.846 | 1.00 | 0.00 | XXXX | 4354 |
| ATOM | 4355 | CE | LYS B | 202 | 37.003 | 28.481 | 39.477 | 1.00 | 0.00 | XXXX | 4355 |
| ATOM | 4356 | NZ | LYS B | 202 | 37.115 | 29.479 | 38.379 | 1.00 | 0.00 | XXXX | 4356 |
| ATOM | 4357 | N | PRO B | 203 | 34.447 | 33.116 | 44.758 | 1.00 | 0.00 | XXXX | 4357 |
| ATOM | 4358 | CA | PRO B | 203 | 34.336 | 33.447 | 46.182 | 1.00 | 0.00 | XXXX | 4358 |
| ATOM | 4359 | C | PRO B | 203 | 33.670 | 32.333 | 46.990 | 1.00 | 0.00 | XXXX | 4359 |
| ATOM | 4360 | O | PRO B | 203 | 33.055 | 31.441 | 46.407 | 1.00 | 0.00 | XXXX | 4360 |
| ATOM | 4361 | CB | PRO B | 203 | 33.470 | 34.707 | 46.174 | 1.00 | 0.00 | XXXX | 4361 |
| ATOM | 4362 | CG | PRO B | 203 | 32.611 | 34.542 | 44.963 | 1.00 | 0.00 | XXXX | 4362 |
| ATOM | 4363 | CD | PRO B | 203 | 33.508 | 33.900 | 43.936 | 1.00 | 0.00 | XXXX | 4363 |
| ATOM | 4364 | N | ASP B | 204 | 33.792 | 32.389 | 48.313 | 1.00 | 0.00 | XXXX | 4364 |
| ATOM | 4365 | CA | ASP B | 204 | 33.114 | 31.433 | 49.184 | 1.00 | 0.00 | XXXX | 4365 |
| ATOM | 4366 | C | ASP B | 204 | 31.644 | 31.793 | 49.317 | 1.00 | 0.00 | XXXX | 4366 |
| ATOM | 4367 | O | ASP B | 204 | 30.788 | 30.925 | 49.490 | 1.00 | 0.00 | XXXX | 4367 |
| ATOM | 4368 | CB | ASP B | 204 | 33.764 | 31.397 | 50.569 | 1.00 | 0.00 | XXXX | 4368 |
| ATOM | 4369 | CG | ASP B | 204 | 35.220 | 30.992 | 50.522 | 1.00 | 0.00 | XXXX | 4369 |
| ATOM | 4370 | OD1 | ASP B | 204 | 35.634 | 30.371 | 49.520 | 1.00 | 0.00 | XXXX | 4370 |
| ATOM | 4371 | OD2 | ASP B | 204 | 35.949 | 31.292 | 51.491 | 1.00 | 0.00 | XXXX | 4371 |
| ATOM | 4372 | N | VAL B | 205 | 31.362 | 33.088 | 49.236 | 1.00 | 0.00 | XXXX | 4372 |
| ATOM | 4373 | CA | VAL B | 205 | 30.018 | 33.598 | 49.449 | 1.00 | 0.00 | XXXX | 4373 |
| ATOM | 4374 | C | VAL B | 205 | 29.843 | 34.950 | 48.774 | 1.00 | 0.00 | XXXX | 4374 |
| ATOM | 4375 | O | VAL B | 205 | 30.779 | 35.749 | 48.702 | 1.00 | 0.00 | XXXX | 4375 |
| ATOM | 4376 | CB | VAL B | 205 | 29.700 | 33.739 | 50.953 | 1.00 | 0.00 | XXXX | 4376 |
| ATOM | 4377 | CG1 | VAL B | 205 | 30.623 | 34.763 | 51.598 | 1.00 | 0.00 | XXXX | 4377 |
| ATOM | 4378 | CG2 | VAL B | 205 | 28.241 | 34.122 | 51.161 | 1.00 | 0.00 | XXXX | 4378 |
| ATOM | 4379 | N | VAL B | 206 | 28.640 | 35.199 | 48.273 | 1.00 | 0.00 | XXXX | 4379 |
| ATOM | 4380 | CA | VAL B | 206 | 28.288 | 36.520 | 47.784 | 1.00 | 0.00 | XXXX | 4380 |
| ATOM | 4381 | C | VAL B | 206 | 27.447 | 37.233 | 48.832 | 1.00 | 0.00 | XXXX | 4381 |
| ATOM | 4382 | O | VAL B | 206 | 26.423 | 36.712 | 49.274 | 1.00 | 0.00 | XXXX | 4382 |
| ATOM | 4383 | CB | VAL B | 206 | 27.511 | 36.451 | 46.456 | 1.00 | 0.00 | XXXX | 4383 |
| ATOM | 4384 | CG1 | VAL B | 206 | 27.139 | 37.851 | 45.988 | 1.00 | 0.00 | XXXX | 4384 |
| ATOM | 4385 | CG2 | VAL B | 206 | 28.331 | 35.728 | 45.398 | 1.00 | 0.00 | XXXX | 4385 |
| ATOM | 4386 | N | PHE B | 207 | 27.882 | 38.420 | 49.239 | 1.00 | 0.00 | XXXX | 4386 |
| ATOM | 4387 | CA | PHE B | 207 | 27.082 | 39.226 | 50.149 | 1.00 | 0.00 | XXXX | 4387 |
| ATOM | 4388 | C | PHE B | 207 | 26.330 | 40.270 | 49.343 | 1.00 | 0.00 | XXXX | 4388 |
| ATOM | 4389 | O | PHE B | 207 | 26.919 | 41.220 | 48.828 | 1.00 | 0.00 | XXXX | 4389 |
| ATOM | 4390 | CB | PHE B | 207 | 27.944 | 39.884 | 51.226 | 1.00 | 0.00 | XXXX | 4390 |
| ATOM | 4391 | CG | PHE B | 207 | 27.180 | 40.243 | 52.470 | 1.00 | 0.00 | XXXX | 4391 |
| ATOM | 4392 | CD1 | PHE B | 207 | 26.283 | 41.299 | 52.470 | 1.00 | 0.00 | XXXX | 4392 |
| ATOM | 4393 | CD2 | PHE B | 207 | 27.343 | 39.510 | 53.634 | 1.00 | 0.00 | XXXX | 4393 |
| ATOM | 4394 | CE1 | PHE B | 207 | 25.571 | 41.624 | 53.611 | 1.00 | 0.00 | XXXX | 4394 |
| ATOM | 4395 | CE2 | PHE B | 207 | 26.634 | 39.830 | 54.778 | 1.00 | 0.00 | XXXX | 4395 |

-continued

| | | | | | | | | | | |
|---|---|---|---|---|---|---|---|---|---|---|
| ATOM | 4396 | CZ | PHE B | 207 | 25.748 | 40.889 | 54.767 | 1.00 | 0.00 | XXXX | 4396 |
| ATOM | 4397 | N | ASN B | 208 | 25.019 | 40.076 | 49.242 | 1.00 | 0.00 | XXXX | 4397 |
| ATOM | 4398 | CA | ASN B | 208 | 24.173 | 40.856 | 48.347 | 1.00 | 0.00 | XXXX | 4398 |
| ATOM | 4399 | C | ASN B | 208 | 23.475 | 42.031 | 49.022 | 1.00 | 0.00 | XXXX | 4399 |
| ATOM | 4400 | O | ASN B | 208 | 22.643 | 41.844 | 49.911 | 1.00 | 0.00 | XXXX | 4400 |
| ATOM | 4401 | CB | ASN B | 208 | 23.126 | 39.940 | 47.709 | 1.00 | 0.00 | XXXX | 4401 |
| ATOM | 4402 | CG | ASN B | 208 | 22.131 | 40.699 | 46.857 | 1.00 | 0.00 | XXXX | 4402 |
| ATOM | 4403 | OD1 | ASN B | 208 | 22.478 | 41.685 | 46.210 | 1.00 | 0.00 | XXXX | 4403 |
| ATOM | 4404 | ND2 | ASN B | 208 | 20.881 | 40.246 | 46.859 | 1.00 | 0.00 | XXXX | 4404 |
| ATOM | 4405 | N | THR B | 209 | 23.813 | 43.241 | 48.590 | 1.00 | 0.00 | XXXX | 4405 |
| ATOM | 4406 | CA | THR B | 209 | 23.137 | 44.438 | 49.076 | 1.00 | 0.00 | XXXX | 4406 |
| ATOM | 4407 | C | THR B | 209 | 22.377 | 45.137 | 47.952 | 1.00 | 0.00 | XXXX | 4407 |
| ATOM | 4408 | O | THR B | 209 | 22.073 | 46.326 | 48.047 | 1.00 | 0.00 | XXXX | 4408 |
| ATOM | 4409 | CB | THR B | 209 | 24.126 | 45.436 | 49.717 | 1.00 | 0.00 | XXXX | 4409 |
| ATOM | 4410 | OG1 | THR B | 209 | 25.236 | 45.658 | 48.838 | 1.00 | 0.00 | XXXX | 4410 |
| ATOM | 4411 | CG2 | THR B | 209 | 24.634 | 44.901 | 51.047 | 1.00 | 0.00 | XXXX | 4411 |
| ATOM | 4412 | N | LEU B | 210 | 22.068 | 44.393 | 46.892 | 1.00 | 0.00 | XXXX | 4412 |
| ATOM | 4413 | CA | LEU B | 210 | 21.184 | 44.897 | 45.845 | 1.00 | 0.00 | XXXX | 4413 |
| ATOM | 4414 | C | LEU B | 210 | 19.832 | 45.273 | 46.438 | 1.00 | 0.00 | XXXX | 4414 |
| ATOM | 4415 | O | LEU B | 210 | 19.294 | 44.551 | 47.277 | 1.00 | 0.00 | XXXX | 4415 |
| ATOM | 4416 | CB | LEU B | 210 | 20.991 | 43.857 | 44.737 | 1.00 | 0.00 | XXXX | 4416 |
| ATOM | 4417 | CG | LEU B | 210 | 22.181 | 43.459 | 43.859 | 1.00 | 0.00 | XXXX | 4417 |
| ATOM | 4418 | CD1 | LEU B | 210 | 21.787 | 42.322 | 42.930 | 1.00 | 0.00 | XXXX | 4418 |
| ATOM | 4419 | CD2 | LEU B | 210 | 22.700 | 44.643 | 43.059 | 1.00 | 0.00 | XXXX | 4419 |
| ATOM | 4420 | N | ASN B | 211 | 19.290 | 46.405 | 46.000 | 1.00 | 0.00 | XXXX | 4420 |
| ATOM | 4421 | CA | ASN B | 211 | 17.962 | 46.832 | 46.423 | 1.00 | 0.00 | XXXX | 4421 |
| ATOM | 4422 | C | ASN B | 211 | 17.025 | 46.987 | 45.228 | 1.00 | 0.00 | XXXX | 4422 |
| ATOM | 4423 | O | ASN B | 211 | 17.451 | 47.373 | 44.139 | 1.00 | 0.00 | XXXX | 4423 |
| ATOM | 4424 | CB | ASN B | 211 | 18.043 | 48.142 | 47.209 | 1.00 | 0.00 | XXXX | 4424 |
| ATOM | 4425 | CG | ASN B | 211 | 18.406 | 47.925 | 48.668 | 1.00 | 0.00 | XXXX | 4425 |
| ATOM | 4426 | OD1 | ASN B | 211 | 17.581 | 48.116 | 49.562 | 1.00 | 0.00 | XXXX | 4426 |
| ATOM | 4427 | ND2 | ASN B | 211 | 19.650 | 47.528 | 48.916 | 1.00 | 0.00 | XXXX | 4427 |
| ATOM | 4428 | N | GLY B | 212 | 15.747 | 46.683 | 45.435 | 1.00 | 0.00 | XXXX | 4428 |
| ATOM | 4429 | CA | GLY B | 212 | 14.751 | 46.856 | 44.393 | 1.00 | 0.00 | XXXX | 4429 |
| ATOM | 4430 | C | GLY B | 212 | 14.765 | 45.718 | 43.390 | 1.00 | 0.00 | XXXX | 4430 |
| ATOM | 4431 | O | GLY B | 212 | 15.342 | 44.663 | 43.649 | 1.00 | 0.00 | XXXX | 4431 |
| ATOM | 4432 | N | ASP B | 213 | 14.135 | 45.932 | 42.237 | 1.00 | 0.00 | XXXX | 4432 |
| ATOM | 4433 | CA | ASP B | 213 | 13.898 | 44.846 | 41.292 | 1.00 | 0.00 | XXXX | 4433 |
| ATOM | 4434 | C | ASP B | 213 | 15.135 | 44.468 | 40.477 | 1.00 | 0.00 | XXXX | 4434 |
| ATOM | 4435 | O | ASP B | 213 | 15.062 | 43.616 | 39.593 | 1.00 | 0.00 | XXXX | 4435 |
| ATOM | 4436 | CB | ASP B | 213 | 12.735 | 45.198 | 40.355 | 1.00 | 0.00 | XXXX | 4436 |
| ATOM | 4437 | CG | ASP B | 213 | 12.947 | 46.503 | 39.606 | 1.00 | 0.00 | XXXX | 4437 |
| ATOM | 4438 | OD1 | ASP B | 213 | 14.110 | 46.902 | 39.381 | 1.00 | 0.00 | XXXX | 4438 |
| ATOM | 4439 | OD2 | ASP B | 213 | 11.934 | 47.131 | 39.236 | 1.00 | 0.00 | XXXX | 4439 |
| ATOM | 4440 | N | SER B | 214 | 16.263 | 45.110 | 40.767 | 1.00 | 0.00 | XXXX | 4440 |
| ATOM | 4441 | CA | SER B | 214 | 17.548 | 44.630 | 40.276 | 1.00 | 0.00 | XXXX | 4441 |
| ATOM | 4442 | C | SER B | 214 | 17.756 | 43.183 | 40.719 | 1.00 | 0.00 | XXXX | 4442 |
| ATOM | 4443 | O | SER B | 214 | 18.384 | 42.393 | 40.018 | 1.00 | 0.00 | XXXX | 4443 |
| ATOM | 4444 | CB | SER B | 214 | 18.694 | 45.512 | 40.777 | 1.00 | 0.00 | XXXX | 4444 |
| ATOM | 4445 | OG | SER B | 214 | 18.853 | 46.661 | 39.963 | 1.00 | 0.00 | XXXX | 4445 |
| ATOM | 4446 | N | ASN B | 215 | 17.221 | 42.849 | 41.891 | 1.00 | 0.00 | XXXX | 4446 |
| ATOM | 4447 | CA | ASN B | 215 | 17.325 | 41.500 | 42.438 | 1.00 | 0.00 | XXXX | 4447 |
| ATOM | 4448 | C | ASN B | 215 | 16.641 | 40.455 | 41.565 | 1.00 | 0.00 | XXXX | 4448 |
| ATOM | 4449 | O | ASN B | 215 | 17.068 | 39.301 | 41.513 | 1.00 | 0.00 | XXXX | 4449 |
| ATOM | 4450 | CB | ASN B | 215 | 16.737 | 41.454 | 43.848 | 1.00 | 0.00 | XXXX | 4450 |
| ATOM | 4451 | CG | ASN B | 215 | 17.669 | 42.046 | 44.886 | 1.00 | 0.00 | XXXX | 4451 |
| ATOM | 4452 | OD1 | ASN B | 215 | 18.631 | 41.404 | 45.307 | 1.00 | 0.00 | XXXX | 4452 |
| ATOM | 4453 | ND2 | ASN B | 215 | 17.389 | 43.275 | 45.304 | 1.00 | 0.00 | XXXX | 4453 |
| ATOM | 4454 | N | VAL B | 216 | 15.571 | 40.860 | 40.889 | 1.00 | 0.00 | XXXX | 4454 |
| ATOM | 4455 | CA | VAL B | 216 | 14.859 | 39.956 | 39.997 | 1.00 | 0.00 | XXXX | 4455 |
| ATOM | 4456 | C | VAL B | 216 | 15.784 | 39.518 | 38.870 | 1.00 | 0.00 | XXXX | 4456 |
| ATOM | 4457 | O | VAL B | 216 | 15.860 | 38.335 | 38.537 | 1.00 | 0.00 | XXXX | 4457 |
| ATOM | 4458 | CB | VAL B | 216 | 13.595 | 40.607 | 39.402 | 1.00 | 0.00 | XXXX | 4458 |
| ATOM | 4459 | CG1 | VAL B | 216 | 12.941 | 39.669 | 38.394 | 1.00 | 0.00 | XXXX | 4459 |
| ATOM | 4460 | CG2 | VAL B | 216 | 12.618 | 40.980 | 40.507 | 1.00 | 0.00 | XXXX | 4460 |
| ATOM | 4461 | N | ALA B | 217 | 16.490 | 40.485 | 38.292 | 1.00 | 0.00 | XXXX | 4461 |
| ATOM | 4462 | CA | ALA B | 217 | 17.400 | 40.224 | 37.183 | 1.00 | 0.00 | XXXX | 4462 |
| ATOM | 4463 | C | ALA B | 217 | 18.618 | 39.410 | 37.616 | 1.00 | 0.00 | XXXX | 4463 |
| ATOM | 4464 | O | ALA B | 217 | 19.026 | 38.478 | 36.922 | 1.00 | 0.00 | XXXX | 4464 |
| ATOM | 4465 | CB | ALA B | 217 | 17.843 | 41.536 | 36.547 | 1.00 | 0.00 | XXXX | 4465 |
| ATOM | 4466 | N | PHE B | 218 | 19.198 | 39.762 | 38.760 | 1.00 | 0.00 | XXXX | 4466 |
| ATOM | 4467 | CA | PHE B | 218 | 20.421 | 39.110 | 39.220 | 1.00 | 0.00 | XXXX | 4467 |
| ATOM | 4468 | C | PHE B | 218 | 20.232 | 37.622 | 39.499 | 1.00 | 0.00 | XXXX | 4468 |
| ATOM | 4469 | O | PHE B | 218 | 20.979 | 36.788 | 38.987 | 1.00 | 0.00 | XXXX | 4469 |
| ATOM | 4470 | CB | PHE B | 218 | 20.959 | 39.791 | 40.479 | 1.00 | 0.00 | XXXX | 4470 |
| ATOM | 4471 | CG | PHE B | 218 | 22.097 | 39.048 | 41.124 | 1.00 | 0.00 | XXXX | 4471 |
| ATOM | 4472 | CD1 | PHE B | 218 | 23.323 | 38.950 | 40.488 | 1.00 | 0.00 | XXXX | 4472 |
| ATOM | 4473 | CD2 | PHE B | 218 | 21.938 | 38.441 | 42.359 | 1.00 | 0.00 | XXXX | 4473 |
| ATOM | 4474 | CE1 | PHE B | 218 | 24.371 | 38.263 | 41.072 | 1.00 | 0.00 | XXXX | 4474 |

-continued

| | | | | | | | | | | |
|---|---|---|---|---|---|---|---|---|---|---|
| ATOM | 4475 | CE2 | PHE B | 218 | 22.984 | 37.753 | 42.950 | 1.00 | 0.00 | XXXX | 4475 |
| ATOM | 4476 | CZ | PHE B | 218 | 24.203 | 37.665 | 42.305 | 1.00 | 0.00 | XXXX | 4476 |
| ATOM | 4477 | N | PHE B | 219 | 19.233 | 37.293 | 40.311 | 1.00 | 0.00 | XXXX | 4477 |
| ATOM | 4478 | CA | PHE B | 219 | 19.047 | 35.917 | 40.758 | 1.00 | 0.00 | XXXX | 4478 |
| ATOM | 4479 | C | PHE B | 219 | 18.577 | 35.011 | 39.626 | 1.00 | 0.00 | XXXX | 4479 |
| ATOM | 4480 | O | PHE B | 219 | 18.919 | 33.829 | 39.591 | 1.00 | 0.00 | XXXX | 4480 |
| ATOM | 4481 | CB | PHE B | 219 | 18.066 | 35.867 | 41.932 | 1.00 | 0.00 | XXXX | 4481 |
| ATOM | 4482 | CG | PHE B | 219 | 18.672 | 36.300 | 43.238 | 1.00 | 0.00 | XXXX | 4482 |
| ATOM | 4483 | CD1 | PHE B | 219 | 19.511 | 35.449 | 43.940 | 1.00 | 0.00 | XXXX | 4483 |
| ATOM | 4484 | CD2 | PHE B | 219 | 18.422 | 37.561 | 43.755 | 1.00 | 0.00 | XXXX | 4484 |
| ATOM | 4485 | CE1 | PHE B | 219 | 20.079 | 35.842 | 45.138 | 1.00 | 0.00 | XXXX | 4485 |
| ATOM | 4486 | CE2 | PHE B | 219 | 18.989 | 37.960 | 44.953 | 1.00 | 0.00 | XXXX | 4486 |
| ATOM | 4487 | CZ | PHE B | 219 | 19.819 | 37.099 | 45.645 | 1.00 | 0.00 | XXXX | 4487 |
| ATOM | 4488 | N | LYS B | 220 | 17.792 | 35.559 | 38.705 | 1.00 | 0.00 | XXXX | 4488 |
| ATOM | 4489 | CA | LYS B | 220 | 17.381 | 34.797 | 37.532 | 1.00 | 0.00 | XXXX | 4489 |
| ATOM | 4490 | C | LYS B | 220 | 18.582 | 34.509 | 36.639 | 1.00 | 0.00 | XXXX | 4490 |
| ATOM | 4491 | O | LYS B | 220 | 18.762 | 33.386 | 36.168 | 1.00 | 0.00 | XXXX | 4491 |
| ATOM | 4492 | CB | LYS B | 220 | 16.296 | 35.538 | 36.746 | 1.00 | 0.00 | XXXX | 4492 |
| ATOM | 4493 | CG | LYS B | 220 | 14.942 | 35.550 | 37.437 | 1.00 | 0.00 | XXXX | 4493 |
| ATOM | 4494 | CD | LYS B | 220 | 13.859 | 36.123 | 36.539 | 1.00 | 0.00 | XXXX | 4494 |
| ATOM | 4495 | CE | LYS B | 220 | 12.523 | 36.198 | 37.265 | 1.00 | 0.00 | XXXX | 4495 |
| ATOM | 4496 | NZ | LYS B | 220 | 11.459 | 36.800 | 36.415 | 1.00 | 0.00 | XXXX | 4496 |
| ATOM | 4497 | N | GLN B | 221 | 19.403 | 35.529 | 36.410 | 1.00 | 0.00 | XXXX | 4497 |
| ATOM | 4498 | CA | GLN B | 221 | 20.580 | 35.384 | 35.560 | 1.00 | 0.00 | XXXX | 4498 |
| ATOM | 4499 | C | GLN B | 221 | 21.650 | 34.531 | 36.235 | 1.00 | 0.00 | XXXX | 4499 |
| ATOM | 4500 | O | GLN B | 221 | 22.424 | 33.847 | 35.565 | 1.00 | 0.00 | XXXX | 4500 |
| ATOM | 4501 | CB | GLN B | 221 | 21.148 | 36.757 | 35.190 | 1.00 | 0.00 | XXXX | 4501 |
| ATOM | 4502 | CG | GLN B | 221 | 20.354 | 37.484 | 34.110 | 1.00 | 0.00 | XXXX | 4502 |
| ATOM | 4503 | CD | GLN B | 221 | 20.734 | 38.948 | 33.986 | 1.00 | 0.00 | XXXX | 4503 |
| ATOM | 4504 | OE1 | GLN B | 221 | 21.915 | 39.295 | 33.963 | 1.00 | 0.00 | XXXX | 4504 |
| ATOM | 4505 | NE2 | GLN B | 221 | 19.731 | 39.815 | 33.901 | 1.00 | 0.00 | XXXX | 4505 |
| ATOM | 4506 | N | LEU B | 222 | 21.691 | 34.577 | 37.563 | 1.00 | 0.00 | XXXX | 4506 |
| ATOM | 4507 | CA | LEU B | 222 | 22.634 | 33.767 | 38.326 | 1.00 | 0.00 | XXXX | 4507 |
| ATOM | 4508 | C | LEU B | 222 | 22.363 | 32.275 | 38.142 | 1.00 | 0.00 | XXXX | 4508 |
| ATOM | 4509 | O | LEU B | 222 | 23.276 | 31.499 | 37.857 | 1.00 | 0.00 | XXXX | 4509 |
| ATOM | 4510 | CB | LEU B | 222 | 22.572 | 34.130 | 39.811 | 1.00 | 0.00 | XXXX | 4510 |
| ATOM | 4511 | CG | LEU B | 222 | 23.600 | 33.436 | 40.708 | 1.00 | 0.00 | XXXX | 4511 |
| ATOM | 4512 | CD1 | LEU B | 222 | 25.014 | 33.856 | 40.328 | 1.00 | 0.00 | XXXX | 4512 |
| ATOM | 4513 | CD2 | LEU B | 222 | 23.320 | 33.716 | 42.179 | 1.00 | 0.00 | XXXX | 4513 |
| ATOM | 4514 | N | LYS B | 223 | 21.104 | 31.882 | 38.301 | 1.00 | 0.00 | XXXX | 4514 |
| ATOM | 4515 | CA | LYS B | 223 | 20.712 | 30.488 | 38.125 | 1.00 | 0.00 | XXXX | 4515 |
| ATOM | 4516 | C | LYS B | 223 | 20.885 | 30.045 | 36.674 | 1.00 | 0.00 | XXXX | 4516 |
| ATOM | 4517 | O | LYS B | 223 | 21.340 | 28.933 | 36.408 | 1.00 | 0.00 | XXXX | 4517 |
| ATOM | 4518 | CB | LYS B | 223 | 19.266 | 30.272 | 38.577 | 1.00 | 0.00 | XXXX | 4518 |
| ATOM | 4519 | CG | LYS B | 223 | 18.809 | 28.825 | 38.494 | 1.00 | 0.00 | XXXX | 4519 |
| ATOM | 4520 | CD | LYS B | 223 | 17.380 | 28.661 | 38.982 | 1.00 | 0.00 | XXXX | 4520 |
| ATOM | 4521 | CE | LYS B | 223 | 16.917 | 27.218 | 38.850 | 1.00 | 0.00 | XXXX | 4521 |
| ATOM | 4522 | NZ | LYS B | 223 | 17.794 | 26.280 | 39.608 | 1.00 | 0.00 | XXXX | 4522 |
| ATOM | 4523 | N | ASP B | 224 | 20.516 | 30.914 | 35.738 | 1.00 | 0.00 | XXXX | 4523 |
| ATOM | 4524 | CA | ASP B | 224 | 20.619 | 30.588 | 34.320 | 1.00 | 0.00 | XXXX | 4524 |
| ATOM | 4525 | C | ASP B | 224 | 22.081 | 30.480 | 33.903 | 1.00 | 0.00 | XXXX | 4525 |
| ATOM | 4526 | O | ASP B | 224 | 22.403 | 29.846 | 32.899 | 1.00 | 0.00 | XXXX | 4526 |
| ATOM | 4527 | CB | ASP B | 224 | 19.906 | 31.638 | 33.465 | 1.00 | 0.00 | XXXX | 4527 |
| ATOM | 4528 | CG | ASP B | 224 | 18.399 | 31.600 | 33.628 | 1.00 | 0.00 | XXXX | 4528 |
| ATOM | 4529 | OD1 | ASP B | 224 | 17.886 | 30.628 | 34.222 | 1.00 | 0.00 | XXXX | 4529 |
| ATOM | 4530 | OD2 | ASP B | 224 | 17.727 | 32.543 | 33.159 | 1.00 | 0.00 | XXXX | 4530 |
| ATOM | 4531 | N | ALA B | 225 | 22.960 | 31.105 | 34.680 | 1.00 | 0.00 | XXXX | 4531 |
| ATOM | 4532 | CA | ALA B | 225 | 24.396 | 31.025 | 34.436 | 1.00 | 0.00 | XXXX | 4532 |
| ATOM | 4533 | C | ALA B | 225 | 24.989 | 29.755 | 35.040 | 1.00 | 0.00 | XXXX | 4533 |
| ATOM | 4534 | O | ALA B | 225 | 26.196 | 29.527 | 34.967 | 1.00 | 0.00 | XXXX | 4534 |
| ATOM | 4535 | CB | ALA B | 225 | 25.097 | 32.257 | 34.992 | 1.00 | 0.00 | XXXX | 4535 |
| ATOM | 4536 | N | GLY B | 226 | 24.132 | 28.930 | 35.635 | 1.00 | 0.00 | XXXX | 4536 |
| ATOM | 4537 | CA | GLY B | 226 | 24.544 | 27.637 | 36.151 | 1.00 | 0.00 | XXXX | 4537 |
| ATOM | 4538 | C | GLY B | 226 | 25.025 | 27.636 | 37.591 | 1.00 | 0.00 | XXXX | 4538 |
| ATOM | 4539 | O | GLY B | 226 | 25.616 | 26.659 | 38.049 | 1.00 | 0.00 | XXXX | 4539 |
| ATOM | 4540 | N | ILE B | 227 | 24.784 | 28.730 | 38.308 | 1.00 | 0.00 | XXXX | 4540 |
| ATOM | 4541 | CA | ILE B | 227 | 25.192 | 28.817 | 39.707 | 1.00 | 0.00 | XXXX | 4541 |
| ATOM | 4542 | C | ILE B | 227 | 24.015 | 28.632 | 40.666 | 1.00 | 0.00 | XXXX | 4542 |
| ATOM | 4543 | O | ILE B | 227 | 23.060 | 29.407 | 40.638 | 1.00 | 0.00 | XXXX | 4543 |
| ATOM | 4544 | CB | ILE B | 227 | 25.861 | 30.171 | 40.007 | 1.00 | 0.00 | XXXX | 4544 |
| ATOM | 4545 | CG1 | ILE B | 227 | 27.127 | 30.341 | 39.164 | 1.00 | 0.00 | XXXX | 4545 |
| ATOM | 4546 | CD1 | ILE B | 227 | 27.682 | 31.748 | 39.179 | 1.00 | 0.00 | XXXX | 4546 |
| ATOM | 4547 | CG2 | ILE B | 227 | 26.173 | 30.294 | 41.493 | 1.00 | 0.00 | XXXX | 4547 |
| ATOM | 4548 | N | ASP B | 228 | 24.083 | 27.602 | 41.506 | 1.00 | 0.00 | XXXX | 4548 |
| ATOM | 4549 | CA | ASP B | 228 | 23.059 | 27.380 | 42.528 | 1.00 | 0.00 | XXXX | 4549 |
| ATOM | 4550 | C | ASP B | 228 | 23.613 | 27.589 | 43.940 | 1.00 | 0.00 | XXXX | 4550 |
| ATOM | 4551 | O | ASP B | 228 | 24.819 | 27.754 | 44.126 | 1.00 | 0.00 | XXXX | 4551 |
| ATOM | 4552 | CB | ASP B | 228 | 22.429 | 25.985 | 42.385 | 1.00 | 0.00 | XXXX | 4552 |
| ATOM | 4553 | CG | ASP B | 228 | 23.423 | 24.851 | 42.583 | 1.00 | 0.00 | XXXX | 4553 |

| | | | | | -continued | | | | | |
|---|---|---|---|---|---|---|---|---|---|---|
| ATOM | 4554 | OD1 | ASP B | 228 | 24.532 | 25.082 | 43.108 | 1.00 | 0.00 | XXXX | 4554 |
| ATOM | 4555 | OD2 | ASP B | 228 | 23.081 | 23.709 | 42.210 | 1.00 | 0.00 | XXXX | 4555 |
| ATOM | 4556 | N | ALA B | 229 | 22.721 | 27.580 | 44.925 | 1.00 | 0.00 | XXXX | 4556 |
| ATOM | 4557 | CA | ALA B | 229 | 23.078 | 27.882 | 46.309 | 1.00 | 0.00 | XXXX | 4557 |
| ATOM | 4558 | C | ALA B | 229 | 24.057 | 26.873 | 46.911 | 1.00 | 0.00 | XXXX | 4558 |
| ATOM | 4559 | O | ALA B | 229 | 24.769 | 27.188 | 47.864 | 1.00 | 0.00 | XXXX | 4559 |
| ATOM | 4560 | CB | ALA B | 229 | 21.821 | 27.960 | 47.164 | 1.00 | 0.00 | XXXX | 4560 |
| ATOM | 4561 | N | ASN B | 230 | 24.093 | 25.663 | 46.362 | 1.00 | 0.00 | XXXX | 4561 |
| ATOM | 4562 | CA | ASN B | 230 | 25.020 | 24.646 | 46.855 | 1.00 | 0.00 | XXXX | 4562 |
| ATOM | 4563 | C | ASN B | 230 | 26.466 | 24.995 | 46.520 | 1.00 | 0.00 | XXXX | 4563 |
| ATOM | 4564 | O | ASN B | 230 | 27.359 | 24.849 | 47.355 | 1.00 | 0.00 | XXXX | 4564 |
| ATOM | 4565 | CB | ASN B | 230 | 24.674 | 23.274 | 46.267 | 1.00 | 0.00 | XXXX | 4565 |
| ATOM | 4566 | CG | ASN B | 230 | 23.417 | 22.679 | 46.871 | 1.00 | 0.00 | XXXX | 4566 |
| ATOM | 4567 | OD1 | ASN B | 230 | 23.147 | 22.844 | 48.061 | 1.00 | 0.00 | XXXX | 4567 |
| ATOM | 4568 | ND2 | ASN B | 230 | 22.642 | 21.979 | 46.051 | 1.00 | 0.00 | XXXX | 4568 |
| ATOM | 4569 | N | THR B | 231 | 26.687 | 25.453 | 45.293 | 1.00 | 0.00 | XXXX | 4569 |
| ATOM | 4570 | CA | THR B | 231 | 28.019 | 25.842 | 44.843 | 1.00 | 0.00 | XXXX | 4570 |
| ATOM | 4571 | C | THR B | 231 | 28.454 | 27.196 | 45.404 | 1.00 | 0.00 | XXXX | 4571 |
| ATOM | 4572 | O | THR B | 231 | 29.598 | 27.365 | 45.826 | 1.00 | 0.00 | XXXX | 4572 |
| ATOM | 4573 | CB | THR B | 231 | 28.093 | 25.898 | 43.305 | 1.00 | 0.00 | XXXX | 4573 |
| ATOM | 4574 | OG1 | THR B | 231 | 27.668 | 24.644 | 42.757 | 1.00 | 0.00 | XXXX | 4574 |
| ATOM | 4575 | CG2 | THR B | 231 | 29.513 | 26.184 | 42.852 | 1.00 | 0.00 | XXXX | 4575 |
| ATOM | 4576 | N | LEU B | 232 | 27.535 | 28.156 | 45.405 | 1.00 | 0.00 | XXXX | 4576 |
| ATOM | 4577 | CA | LEU B | 232 | 27.832 | 29.504 | 45.879 | 1.00 | 0.00 | XXXX | 4577 |
| ATOM | 4578 | C | LEU B | 232 | 26.634 | 30.149 | 46.566 | 1.00 | 0.00 | XXXX | 4578 |
| ATOM | 4579 | O | LEU B | 232 | 25.745 | 30.681 | 45.901 | 1.00 | 0.00 | XXXX | 4579 |
| ATOM | 4580 | CB | LEU B | 232 | 28.300 | 30.384 | 44.719 | 1.00 | 0.00 | XXXX | 4580 |
| ATOM | 4581 | CG | LEU B | 232 | 28.616 | 31.839 | 45.073 | 1.00 | 0.00 | XXXX | 4581 |
| ATOM | 4582 | CD1 | LEU B | 232 | 29.656 | 31.915 | 46.182 | 1.00 | 0.00 | XXXX | 4582 |
| ATOM | 4583 | CD2 | LEU B | 232 | 29.072 | 32.612 | 43.842 | 1.00 | 0.00 | XXXX | 4583 |
| ATOM | 4584 | N | PRO B | 233 | 26.605 | 30.102 | 47.904 | 1.00 | 0.00 | XXXX | 4584 |
| ATOM | 4585 | CA | PRO B | 233 | 25.507 | 30.721 | 48.651 | 1.00 | 0.00 | XXXX | 4585 |
| ATOM | 4586 | C | PRO B | 233 | 25.532 | 32.243 | 48.549 | 1.00 | 0.00 | XXXX | 4586 |
| ATOM | 4587 | O | PRO B | 233 | 26.605 | 32.849 | 48.561 | 1.00 | 0.00 | XXXX | 4587 |
| ATOM | 4588 | CB | PRO B | 233 | 25.756 | 30.269 | 50.094 | 1.00 | 0.00 | XXXX | 4588 |
| ATOM | 4589 | CG | PRO B | 233 | 27.196 | 29.892 | 50.144 | 1.00 | 0.00 | XXXX | 4589 |
| ATOM | 4590 | CD | PRO B | 233 | 27.562 | 29.404 | 48.780 | 1.00 | 0.00 | XXXX | 4590 |
| ATOM | 4591 | N | VAL B | 234 | 24.352 | 32.845 | 48.437 | 1.00 | 0.00 | XXXX | 4591 |
| ATOM | 4592 | CA | VAL B | 234 | 24.217 | 34.295 | 48.446 | 1.00 | 0.00 | XXXX | 4592 |
| ATOM | 4593 | C | VAL B | 234 | 23.498 | 34.754 | 49.710 | 1.00 | 0.00 | XXXX | 4593 |
| ATOM | 4594 | O | VAL B | 234 | 22.367 | 34.342 | 49.974 | 1.00 | 0.00 | XXXX | 4594 |
| ATOM | 4595 | CB | VAL B | 234 | 23.446 | 34.804 | 47.214 | 1.00 | 0.00 | XXXX | 4595 |
| ATOM | 4596 | CG1 | VAL B | 234 | 23.275 | 36.317 | 47.283 | 1.00 | 0.00 | XXXX | 4596 |
| ATOM | 4597 | CG2 | VAL B | 234 | 24.156 | 34.390 | 45.929 | 1.00 | 0.00 | XXXX | 4597 |
| ATOM | 4598 | N | MET B | 235 | 24.156 | 35.605 | 50.490 | 1.00 | 0.00 | XXXX | 4598 |
| ATOM | 4599 | CA | MET B | 235 | 23.531 | 36.200 | 51.666 | 1.00 | 0.00 | XXXX | 4599 |
| ATOM | 4600 | C | MET B | 235 | 22.987 | 37.583 | 51.332 | 1.00 | 0.00 | XXXX | 4600 |
| ATOM | 4601 | O | MET B | 235 | 23.736 | 38.472 | 50.927 | 1.00 | 0.00 | XXXX | 4601 |
| ATOM | 4602 | CB | MET B | 235 | 24.528 | 36.287 | 52.824 | 1.00 | 0.00 | XXXX | 4602 |
| ATOM | 4603 | CG | MET B | 235 | 24.020 | 37.068 | 54.029 | 1.00 | 0.00 | XXXX | 4603 |
| ATOM | 4604 | SD | MET B | 235 | 22.682 | 36.240 | 54.913 | 1.00 | 0.00 | XXXX | 4604 |
| ATOM | 4605 | CE | MET B | 235 | 23.577 | 34.965 | 55.798 | 1.00 | 0.00 | XXXX | 4605 |
| ATOM | 4606 | N | SER B | 236 | 21.681 | 37.756 | 51.505 | 1.00 | 0.00 | XXXX | 4606 |
| ATOM | 4607 | CA | SER B | 236 | 21.019 | 39.012 | 51.174 | 1.00 | 0.00 | XXXX | 4607 |
| ATOM | 4608 | C | SER B | 236 | 20.482 | 39.699 | 52.424 | 1.00 | 0.00 | XXXX | 4608 |
| ATOM | 4609 | O | SER B | 236 | 20.066 | 39.037 | 53.374 | 1.00 | 0.00 | XXXX | 4609 |
| ATOM | 4610 | CB | SER B | 236 | 19.881 | 38.768 | 50.181 | 1.00 | 0.00 | XXXX | 4610 |
| ATOM | 4611 | OG | SER B | 236 | 20.374 | 38.250 | 48.958 | 1.00 | 0.00 | XXXX | 4611 |
| ATOM | 4612 | N | VAL B | 237 | 20.491 | 41.029 | 52.419 | 1.00 | 0.00 | XXXX | 4612 |
| ATOM | 4613 | CA | VAL B | 237 | 20.001 | 41.790 | 53.562 | 1.00 | 0.00 | XXXX | 4613 |
| ATOM | 4614 | C | VAL B | 237 | 18.934 | 42.821 | 53.194 | 1.00 | 0.00 | XXXX | 4614 |
| ATOM | 4615 | O | VAL B | 237 | 18.449 | 43.542 | 54.063 | 1.00 | 0.00 | XXXX | 4615 |
| ATOM | 4616 | CB | VAL B | 237 | 21.155 | 42.519 | 54.281 | 1.00 | 0.00 | XXXX | 4616 |
| ATOM | 4617 | CG1 | VAL B | 237 | 22.074 | 41.517 | 54.970 | 1.00 | 0.00 | XXXX | 4617 |
| ATOM | 4618 | CG2 | VAL B | 237 | 21.928 | 43.385 | 53.299 | 1.00 | 0.00 | XXXX | 4618 |
| ATOM | 4619 | N | SER B | 238 | 18.566 | 42.895 | 51.918 | 1.00 | 0.00 | XXXX | 4619 |
| ATOM | 4620 | CA | SER B | 238 | 17.566 | 43.869 | 51.487 | 1.00 | 0.00 | XXXX | 4620 |
| ATOM | 4621 | C | SER B | 238 | 16.432 | 43.230 | 50.692 | 1.00 | 0.00 | XXXX | 4621 |
| ATOM | 4622 | O | SER B | 238 | 15.631 | 43.928 | 50.068 | 1.00 | 0.00 | XXXX | 4622 |
| ATOM | 4623 | CB | SER B | 238 | 18.220 | 44.979 | 50.660 | 1.00 | 0.00 | XXXX | 4623 |
| ATOM | 4624 | OG | SER B | 238 | 19.195 | 45.675 | 51.420 | 1.00 | 0.00 | XXXX | 4624 |
| ATOM | 4625 | N | ILE B | 239 | 16.366 | 41.903 | 50.717 | 1.00 | 0.00 | XXXX | 4625 |
| ATOM | 4626 | CA | ILE B | 239 | 15.205 | 41.192 | 50.196 | 1.00 | 0.00 | XXXX | 4626 |
| ATOM | 4627 | C | ILE B | 239 | 14.707 | 40.188 | 51.227 | 1.00 | 0.00 | XXXX | 4627 |
| ATOM | 4628 | O | ILE B | 239 | 15.492 | 39.623 | 51.989 | 1.00 | 0.00 | XXXX | 4628 |
| ATOM | 4629 | CB | ILE B | 239 | 15.510 | 40.449 | 48.878 | 1.00 | 0.00 | XXXX | 4629 |
| ATOM | 4630 | CG1 | ILE B | 239 | 16.614 | 39.410 | 49.083 | 1.00 | 0.00 | XXXX | 4630 |
| ATOM | 4631 | CG2 | ILE B | 239 | 15.865 | 41.438 | 47.771 | 1.00 | 0.00 | XXXX | 4631 |
| ATOM | 4632 | CD1 | ILE B | 239 | 16.690 | 38.383 | 47.977 | 1.00 | 0.00 | XXXX | 4632 |

-continued

| | | | | | | | | | | |
|---|---|---|---|---|---|---|---|---|---|---|
| ATOM | 4633 | N | ALA B | 240 | 13.398 | 39.970 | 51.243 | 1.00 | 0.00 | XXXX | 4633 |
| ATOM | 4634 | CA | ALA B | 240 | 12.792 | 38.995 | 52.138 | 1.00 | 0.00 | XXXX | 4634 |
| ATOM | 4635 | C | ALA B | 240 | 11.644 | 38.290 | 51.423 | 1.00 | 0.00 | XXXX | 4635 |
| ATOM | 4636 | O | ALA B | 240 | 11.623 | 38.231 | 50.191 | 1.00 | 0.00 | XXXX | 4636 |
| ATOM | 4637 | CB | ALA B | 240 | 12.307 | 39.666 | 53.417 | 1.00 | 0.00 | XXXX | 4637 |
| ATOM | 4638 | N | GLU B | 241 | 10.700 | 37.756 | 52.192 | 1.00 | 0.00 | XXXX | 4638 |
| ATOM | 4639 | CA | GLU B | 241 | 9.616 | 36.943 | 51.640 | 1.00 | 0.00 | XXXX | 4639 |
| ATOM | 4640 | C | GLU B | 241 | 8.847 | 37.637 | 50.516 | 1.00 | 0.00 | XXXX | 4640 |
| ATOM | 4641 | O | GLU B | 241 | 8.434 | 36.992 | 49.553 | 1.00 | 0.00 | XXXX | 4641 |
| ATOM | 4642 | CB | GLU B | 241 | 8.638 | 36.534 | 52.747 | 1.00 | 0.00 | XXXX | 4642 |
| ATOM | 4643 | CG | GLU B | 241 | 9.152 | 35.429 | 53.660 | 1.00 | 0.00 | XXXX | 4643 |
| ATOM | 4644 | CD | GLU B | 241 | 9.861 | 35.960 | 54.891 | 1.00 | 0.00 | XXXX | 4644 |
| ATOM | 4645 | OE1 | GLU B | 241 | 10.489 | 37.036 | 54.801 | 1.00 | 0.00 | XXXX | 4645 |
| ATOM | 4646 | OE2 | GLU B | 241 | 9.790 | 35.300 | 55.950 | 1.00 | 0.00 | XXXX | 4646 |
| ATOM | 4647 | N | GLU B | 242 | 8.651 | 38.945 | 50.639 | 1.00 | 0.00 | XXXX | 4647 |
| ATOM | 4648 | CA | GLU B | 242 | 7.898 | 39.681 | 49.628 | 1.00 | 0.00 | XXXX | 4648 |
| ATOM | 4649 | C | GLU B | 242 | 8.626 | 39.678 | 48.288 | 1.00 | 0.00 | XXXX | 4649 |
| ATOM | 4650 | O | GLU B | 242 | 8.048 | 39.326 | 47.258 | 1.00 | 0.00 | XXXX | 4650 |
| ATOM | 4651 | CB | GLU B | 242 | 7.640 | 41.119 | 50.079 | 1.00 | 0.00 | XXXX | 4651 |
| ATOM | 4652 | CG | GLU B | 242 | 6.948 | 41.973 | 49.029 | 1.00 | 0.00 | XXXX | 4652 |
| ATOM | 4653 | CD | GLU B | 242 | 5.509 | 41.554 | 48.783 | 1.00 | 0.00 | XXXX | 4653 |
| ATOM | 4654 | OE1 | GLU B | 242 | 5.001 | 40.684 | 49.523 | 1.00 | 0.00 | XXXX | 4654 |
| ATOM | 4655 | OE2 | GLU B | 242 | 4.884 | 42.096 | 47.847 | 1.00 | 0.00 | XXXX | 4655 |
| ATOM | 4656 | N | GLU B | 243 | 9.896 | 40.071 | 48.308 | 1.00 | 0.00 | XXXX | 4656 |
| ATOM | 4657 | CA | GLU B | 243 | 10.703 | 40.112 | 47.094 | 1.00 | 0.00 | XXXX | 4657 |
| ATOM | 4658 | C | GLU B | 243 | 10.998 | 38.712 | 46.567 | 1.00 | 0.00 | XXXX | 4658 |
| ATOM | 4659 | O | GLU B | 243 | 11.086 | 38.504 | 45.358 | 1.00 | 0.00 | XXXX | 4659 |
| ATOM | 4660 | CB | GLU B | 243 | 12.013 | 40.864 | 47.341 | 1.00 | 0.00 | XXXX | 4660 |
| ATOM | 4661 | CG | GLU B | 243 | 11.836 | 42.325 | 47.733 | 1.00 | 0.00 | XXXX | 4661 |
| ATOM | 4662 | CD | GLU B | 243 | 11.431 | 42.499 | 49.183 | 1.00 | 0.00 | XXXX | 4662 |
| ATOM | 4663 | OE1 | GLU B | 243 | 11.456 | 41.500 | 49.933 | 1.00 | 0.00 | XXXX | 4663 |
| ATOM | 4664 | OE2 | GLU B | 243 | 11.086 | 43.636 | 49.572 | 1.00 | 0.00 | XXXX | 4664 |
| ATOM | 4665 | N | ILE B | 244 | 11.153 | 37.757 | 47.480 | 1.00 | 0.00 | XXXX | 4665 |
| ATOM | 4666 | CA | ILE B | 244 | 11.414 | 36.372 | 47.104 | 1.00 | 0.00 | XXXX | 4666 |
| ATOM | 4667 | C | ILE B | 244 | 10.272 | 35.812 | 46.260 | 1.00 | 0.00 | XXXX | 4667 |
| ATOM | 4668 | O | ILE B | 244 | 10.502 | 35.096 | 45.285 | 1.00 | 0.00 | XXXX | 4668 |
| ATOM | 4669 | CB | ILE B | 244 | 11.622 | 35.478 | 48.342 | 1.00 | 0.00 | XXXX | 4669 |
| ATOM | 4670 | CG1 | ILE B | 244 | 12.949 | 35.818 | 49.028 | 1.00 | 0.00 | XXXX | 4670 |
| ATOM | 4671 | CG2 | ILE B | 244 | 11.597 | 34.011 | 47.949 | 1.00 | 0.00 | XXXX | 4671 |
| ATOM | 4672 | CD1 | ILE B | 244 | 13.124 | 35.162 | 50.384 | 1.00 | 0.00 | XXXX | 4672 |
| ATOM | 4673 | N | LYS B | 245 | 9.041 | 36.143 | 46.638 | 1.00 | 0.00 | XXXX | 4673 |
| ATOM | 4674 | CA | LYS B | 245 | 7.872 | 35.733 | 45.867 | 1.00 | 0.00 | XXXX | 4674 |
| ATOM | 4675 | C | LYS B | 245 | 7.815 | 36.420 | 44.508 | 1.00 | 0.00 | XXXX | 4675 |
| ATOM | 4676 | O | LYS B | 245 | 7.418 | 35.812 | 43.515 | 1.00 | 0.00 | XXXX | 4676 |
| ATOM | 4677 | CB | LYS B | 245 | 6.588 | 36.019 | 46.648 | 1.00 | 0.00 | XXXX | 4677 |
| ATOM | 4678 | CG | LYS B | 245 | 5.980 | 34.792 | 47.295 | 1.00 | 0.00 | XXXX | 4678 |
| ATOM | 4679 | CD | LYS B | 245 | 5.645 | 33.753 | 46.237 | 1.00 | 0.00 | XXXX | 4679 |
| ATOM | 4680 | CE | LYS B | 245 | 4.934 | 32.551 | 46.831 | 1.00 | 0.00 | XXXX | 4680 |
| ATOM | 4681 | NZ | LYS B | 245 | 4.621 | 31.534 | 45.788 | 1.00 | 0.00 | XXXX | 4681 |
| ATOM | 4682 | N | GLY B | 246 | 8.211 | 37.688 | 44.469 | 1.00 | 0.00 | XXXX | 4682 |
| ATOM | 4683 | CA | GLY B | 246 | 8.228 | 38.440 | 43.228 | 1.00 | 0.00 | XXXX | 4683 |
| ATOM | 4684 | C | GLY B | 246 | 9.284 | 37.923 | 42.272 | 1.00 | 0.00 | XXXX | 4684 |
| ATOM | 4685 | O | GLY B | 246 | 9.045 | 37.795 | 41.072 | 1.00 | 0.00 | XXXX | 4685 |
| ATOM | 4686 | N | ILE B | 247 | 10.460 | 37.624 | 42.812 | 1.00 | 0.00 | XXXX | 4686 |
| ATOM | 4687 | CA | ILE B | 247 | 11.567 | 37.113 | 42.011 | 1.00 | 0.00 | XXXX | 4687 |
| ATOM | 4688 | C | ILE B | 247 | 11.298 | 35.684 | 41.549 | 1.00 | 0.00 | XXXX | 4688 |
| ATOM | 4689 | O | ILE B | 247 | 11.607 | 35.317 | 40.415 | 1.00 | 0.00 | XXXX | 4689 |
| ATOM | 4690 | CB | ILE B | 247 | 12.889 | 37.145 | 42.799 | 1.00 | 0.00 | XXXX | 4690 |
| ATOM | 4691 | CG1 | ILE B | 247 | 13.215 | 38.573 | 43.240 | 1.00 | 0.00 | XXXX | 4691 |
| ATOM | 4692 | CG2 | ILE B | 247 | 14.022 | 36.559 | 41.968 | 1.00 | 0.00 | XXXX | 4692 |
| ATOM | 4693 | CD1 | ILE B | 247 | 14.339 | 38.656 | 44.250 | 1.00 | 0.00 | XXXX | 4693 |
| ATOM | 4694 | N | GLY B | 248 | 10.714 | 34.885 | 42.435 | 1.00 | 0.00 | XXXX | 4694 |
| ATOM | 4695 | CA | GLY B | 248 | 10.502 | 33.474 | 42.169 | 1.00 | 0.00 | XXXX | 4695 |
| ATOM | 4696 | C | GLY B | 248 | 11.397 | 32.615 | 43.039 | 1.00 | 0.00 | XXXX | 4696 |
| ATOM | 4697 | O | GLY B | 248 | 12.616 | 32.630 | 42.883 | 1.00 | 0.00 | XXXX | 4697 |
| ATOM | 4698 | N | PRO B | 249 | 10.793 | 31.860 | 43.969 | 1.00 | 0.00 | XXXX | 4698 |
| ATOM | 4699 | CA | PRO B | 249 | 11.519 | 30.997 | 44.909 | 1.00 | 0.00 | XXXX | 4699 |
| ATOM | 4700 | C | PRO B | 249 | 12.438 | 29.983 | 44.224 | 1.00 | 0.00 | XXXX | 4700 |
| ATOM | 4701 | O | PRO B | 249 | 13.409 | 29.534 | 44.833 | 1.00 | 0.00 | XXXX | 4701 |
| ATOM | 4702 | CB | PRO B | 249 | 10.392 | 30.283 | 45.663 | 1.00 | 0.00 | XXXX | 4702 |
| ATOM | 4703 | CG | PRO B | 249 | 9.239 | 31.226 | 45.582 | 1.00 | 0.00 | XXXX | 4703 |
| ATOM | 4704 | CD | PRO B | 249 | 9.341 | 31.847 | 44.220 | 1.00 | 0.00 | XXXX | 4704 |
| ATOM | 4705 | N | GLU B | 250 | 12.139 | 29.628 | 42.978 | 1.00 | 0.00 | XXXX | 4705 |
| ATOM | 4706 | CA | GLU B | 250 | 12.962 | 28.667 | 42.250 | 1.00 | 0.00 | XXXX | 4706 |
| ATOM | 4707 | C | GLU B | 250 | 14.374 | 29.202 | 42.024 | 1.00 | 0.00 | XXXX | 4707 |
| ATOM | 4708 | O | GLU B | 250 | 15.320 | 28.432 | 41.851 | 1.00 | 0.00 | XXXX | 4708 |
| ATOM | 4709 | CB | GLU B | 250 | 12.321 | 28.310 | 40.905 | 1.00 | 0.00 | XXXX | 4709 |
| ATOM | 4710 | CG | GLU B | 250 | 12.314 | 29.445 | 39.891 | 1.00 | 0.00 | XXXX | 4710 |
| ATOM | 4711 | CD | GLU B | 250 | 11.633 | 29.061 | 38.590 | 1.00 | 0.00 | XXXX | 4711 |

-continued

| | | | | | | | | | | |
|---|---|---|---|---|---|---|---|---|---|---|
| ATOM | 4712 | OE1 | GLU B | 250 | 12.214 | 28.261 | 37.826 | 1.00 | 0.00 | XXXX | 4712 |
| ATOM | 4713 | OE2 | GLU B | 250 | 10.517 | 29.560 | 38.329 | 1.00 | 0.00 | XXXX | 4713 |
| ATOM | 4714 | N | TYR B | 251 | 14.510 | 30.525 | 42.024 | 1.00 | 0.00 | XXXX | 4714 |
| ATOM | 4715 | CA | TYR B | 251 | 15.807 | 31.163 | 41.827 | 1.00 | 0.00 | XXXX | 4715 |
| ATOM | 4716 | C | TYR B | 251 | 16.511 | 31.468 | 43.145 | 1.00 | 0.00 | XXXX | 4716 |
| ATOM | 4717 | O | TYR B | 251 | 17.684 | 31.845 | 43.156 | 1.00 | 0.00 | XXXX | 4717 |
| ATOM | 4718 | CB | TYR B | 251 | 15.642 | 32.457 | 41.025 | 1.00 | 0.00 | XXXX | 4718 |
| ATOM | 4719 | CG | TYR B | 251 | 15.003 | 32.266 | 39.669 | 1.00 | 0.00 | XXXX | 4719 |
| ATOM | 4720 | CD1 | TYR B | 251 | 15.714 | 31.704 | 38.618 | 1.00 | 0.00 | XXXX | 4720 |
| ATOM | 4721 | CD2 | TYR B | 251 | 13.687 | 32.649 | 39.439 | 1.00 | 0.00 | XXXX | 4721 |
| ATOM | 4722 | CE1 | TYR B | 251 | 15.134 | 31.527 | 37.375 | 1.00 | 0.00 | XXXX | 4722 |
| ATOM | 4723 | CE2 | TYR B | 251 | 13.097 | 32.476 | 38.200 | 1.00 | 0.00 | XXXX | 4723 |
| ATOM | 4724 | CZ | TYR B | 251 | 13.826 | 31.915 | 37.172 | 1.00 | 0.00 | XXXX | 4724 |
| ATOM | 4725 | OH | TYR B | 251 | 13.245 | 31.742 | 35.937 | 1.00 | 0.00 | XXXX | 4725 |
| ATOM | 4726 | N | LEU B | 252 | 15.795 | 31.306 | 44.252 | 1.00 | 0.00 | XXXX | 4726 |
| ATOM | 4727 | CA | LEU B | 252 | 16.313 | 31.721 | 45.550 | 1.00 | 0.00 | XXXX | 4727 |
| ATOM | 4728 | C | LEU B | 252 | 16.482 | 30.579 | 46.548 | 1.00 | 0.00 | XXXX | 4728 |
| ATOM | 4729 | O | LEU B | 252 | 17.126 | 30.752 | 47.583 | 1.00 | 0.00 | XXXX | 4729 |
| ATOM | 4730 | CB | LEU B | 252 | 15.402 | 32.797 | 46.144 | 1.00 | 0.00 | XXXX | 4730 |
| ATOM | 4731 | CG | LEU B | 252 | 15.752 | 34.219 | 45.696 | 1.00 | 0.00 | XXXX | 4731 |
| ATOM | 4732 | CD1 | LEU B | 252 | 14.568 | 35.161 | 45.866 | 1.00 | 0.00 | XXXX | 4732 |
| ATOM | 4733 | CD2 | LEU B | 252 | 16.968 | 34.735 | 46.458 | 1.00 | 0.00 | XXXX | 4733 |
| ATOM | 4734 | N | LYS B | 253 | 15.893 | 29.424 | 46.248 | 1.00 | 0.00 | XXXX | 4734 |
| ATOM | 4735 | CA | LYS B | 253 | 15.918 | 28.286 | 47.167 | 1.00 | 0.00 | XXXX | 4735 |
| ATOM | 4736 | C | LYS B | 253 | 17.340 | 27.919 | 47.588 | 1.00 | 0.00 | XXXX | 4736 |
| ATOM | 4737 | O | LYS B | 253 | 18.209 | 27.696 | 46.745 | 1.00 | 0.00 | XXXX | 4737 |
| ATOM | 4738 | CB | LYS B | 253 | 15.232 | 27.067 | 46.544 | 1.00 | 0.00 | XXXX | 4738 |
| ATOM | 4739 | CG | LYS B | 253 | 15.146 | 25.872 | 47.487 | 1.00 | 0.00 | XXXX | 4739 |
| ATOM | 4740 | CD | LYS B | 253 | 14.561 | 24.640 | 46.809 | 1.00 | 0.00 | XXXX | 4740 |
| ATOM | 4741 | CE | LYS B | 253 | 15.537 | 24.026 | 45.819 | 1.00 | 0.00 | XXXX | 4741 |
| ATOM | 4742 | NZ | LYS B | 253 | 15.073 | 22.689 | 45.351 | 1.00 | 0.00 | XXXX | 4742 |
| ATOM | 4743 | N | GLY B | 254 | 17.566 | 27.859 | 48.897 | 1.00 | 0.00 | XXXX | 4743 |
| ATOM | 4744 | CA | GLY B | 254 | 18.859 | 27.478 | 49.437 | 1.00 | 0.00 | XXXX | 4744 |
| ATOM | 4745 | C | GLY B | 254 | 19.753 | 28.658 | 49.767 | 1.00 | 0.00 | XXXX | 4745 |
| ATOM | 4746 | O | GLY B | 254 | 20.732 | 28.516 | 50.500 | 1.00 | 0.00 | XXXX | 4746 |
| ATOM | 4747 | N | HIS B | 255 | 19.424 | 29.825 | 49.224 | 1.00 | 0.00 | XXXX | 4747 |
| ATOM | 4748 | CA | HIS B | 255 | 20.189 | 31.032 | 49.510 | 1.00 | 0.00 | XXXX | 4748 |
| ATOM | 4749 | C | HIS B | 255 | 19.804 | 31.595 | 50.876 | 1.00 | 0.00 | XXXX | 4749 |
| ATOM | 4750 | O | HIS B | 255 | 18.862 | 31.116 | 51.508 | 1.00 | 0.00 | XXXX | 4750 |
| ATOM | 4751 | CB | HIS B | 255 | 19.989 | 32.070 | 48.404 | 1.00 | 0.00 | XXXX | 4751 |
| ATOM | 4752 | CG | HIS B | 255 | 20.710 | 31.735 | 47.135 | 1.00 | 0.00 | XXXX | 4752 |
| ATOM | 4753 | ND1 | HIS B | 255 | 22.083 | 31.628 | 47.066 | 1.00 | 0.00 | XXXX | 4753 |
| ATOM | 4754 | CD2 | HIS B | 255 | 20.250 | 31.470 | 45.889 | 1.00 | 0.00 | XXXX | 4754 |
| ATOM | 4755 | CE1 | HIS B | 255 | 22.438 | 31.318 | 45.832 | 1.00 | 0.00 | XXXX | 4755 |
| ATOM | 4756 | NE2 | HIS B | 255 | 21.344 | 31.216 | 45.098 | 1.00 | 0.00 | XXXX | 4756 |
| ATOM | 4757 | N | LEU B | 256 | 20.528 | 32.615 | 51.325 | 1.00 | 0.00 | XXXX | 4757 |
| ATOM | 4758 | CA | LEU B | 256 | 20.465 | 33.031 | 52.723 | 1.00 | 0.00 | XXXX | 4758 |
| ATOM | 4759 | C | LEU B | 256 | 19.976 | 34.462 | 52.924 | 1.00 | 0.00 | XXXX | 4759 |
| ATOM | 4760 | O | LEU B | 256 | 20.163 | 35.324 | 52.066 | 1.00 | 0.00 | XXXX | 4760 |
| ATOM | 4761 | CB | LEU B | 256 | 21.845 | 32.882 | 53.369 | 1.00 | 0.00 | XXXX | 4761 |
| ATOM | 4762 | CG | LEU B | 256 | 22.514 | 31.511 | 53.260 | 1.00 | 0.00 | XXXX | 4762 |
| ATOM | 4763 | CD1 | LEU B | 256 | 23.947 | 31.573 | 53.766 | 1.00 | 0.00 | XXXX | 4763 |
| ATOM | 4764 | CD2 | LEU B | 256 | 21.720 | 30.457 | 54.018 | 1.00 | 0.00 | XXXX | 4764 |
| ATOM | 4765 | N | VAL B | 257 | 19.349 | 34.700 | 54.072 | 1.00 | 0.00 | XXXX | 4765 |
| ATOM | 4766 | CA | VAL B | 257 | 18.953 | 36.044 | 54.474 | 1.00 | 0.00 | XXXX | 4766 |
| ATOM | 4767 | C | VAL B | 257 | 19.240 | 36.275 | 55.953 | 1.00 | 0.00 | XXXX | 4767 |
| ATOM | 4768 | O | VAL B | 257 | 19.315 | 35.328 | 56.736 | 1.00 | 0.00 | XXXX | 4768 |
| ATOM | 4769 | CB | VAL B | 257 | 17.457 | 36.304 | 54.214 | 1.00 | 0.00 | XXXX | 4769 |
| ATOM | 4770 | CG1 | VAL B | 257 | 17.146 | 36.206 | 52.726 | 1.00 | 0.00 | XXXX | 4770 |
| ATOM | 4771 | CG2 | VAL B | 257 | 16.601 | 35.331 | 55.015 | 1.00 | 0.00 | XXXX | 4771 |
| ATOM | 4772 | N | THR B | 258 | 19.400 | 37.541 | 56.327 | 1.00 | 0.00 | XXXX | 4772 |
| ATOM | 4773 | CA | THR B | 258 | 19.479 | 37.926 | 57.731 | 1.00 | 0.00 | XXXX | 4773 |
| ATOM | 4774 | C | THR B | 258 | 18.492 | 39.053 | 58.014 | 1.00 | 0.00 | XXXX | 4774 |
| ATOM | 4775 | O | THR B | 258 | 18.488 | 40.075 | 57.330 | 1.00 | 0.00 | XXXX | 4775 |
| ATOM | 4776 | CB | THR B | 258 | 20.901 | 38.372 | 58.129 | 1.00 | 0.00 | XXXX | 4776 |
| ATOM | 4777 | OG1 | THR B | 258 | 21.828 | 37.309 | 57.879 | 1.00 | 0.00 | XXXX | 4777 |
| ATOM | 4778 | CG2 | THR B | 258 | 20.951 | 38.740 | 59.606 | 1.00 | 0.00 | XXXX | 4778 |
| ATOM | 4779 | N | TRP B | 259 | 17.656 | 38.856 | 59.026 | 1.00 | 0.00 | XXXX | 4779 |
| ATOM | 4780 | CA | TRP B | 259 | 16.639 | 39.833 | 59.390 | 1.00 | 0.00 | XXXX | 4780 |
| ATOM | 4781 | C | TRP B | 259 | 16.351 | 39.754 | 60.883 | 1.00 | 0.00 | XXXX | 4781 |
| ATOM | 4782 | O | TRP B | 259 | 17.076 | 39.099 | 61.633 | 1.00 | 0.00 | XXXX | 4782 |
| ATOM | 4783 | CB | TRP B | 259 | 15.349 | 39.601 | 58.596 | 1.00 | 0.00 | XXXX | 4783 |
| ATOM | 4784 | CG | TRP B | 259 | 15.444 | 39.931 | 57.132 | 1.00 | 0.00 | XXXX | 4784 |
| ATOM | 4785 | CD1 | TRP B | 259 | 15.646 | 39.053 | 56.107 | 1.00 | 0.00 | XXXX | 4785 |
| ATOM | 4786 | CD2 | TRP B | 259 | 15.312 | 41.226 | 56.529 | 1.00 | 0.00 | XXXX | 4786 |
| ATOM | 4787 | NE1 | TRP B | 259 | 15.663 | 39.722 | 54.906 | 1.00 | 0.00 | XXXX | 4787 |
| ATOM | 4788 | CE2 | TRP B | 259 | 15.457 | 41.056 | 55.138 | 1.00 | 0.00 | XXXX | 4788 |
| ATOM | 4789 | CE3 | TRP B | 259 | 15.091 | 42.511 | 57.032 | 1.00 | 0.00 | XXXX | 4789 |
| ATOM | 4790 | CZ2 | TRP B | 259 | 15.388 | 42.123 | 54.245 | 1.00 | 0.00 | XXXX | 4790 |

-continued

| | | | | | | | | | | |
|---|---|---|---|---|---|---|---|---|---|---|
| ATOM | 4791 | CZ3 | TRP B | 259 | 15.021 | 43.569 | 56.143 | 1.00 | 0.00 | XXXX | 4791 |
| ATOM | 4792 | CH2 | TRP B | 259 | 15.171 | 43.368 | 54.766 | 1.00 | 0.00 | XXXX | 4792 |
| ATOM | 4793 | N | ASN B | 260 | 15.287 | 40.423 | 61.310 | 1.00 | 0.00 | XXXX | 4793 |
| ATOM | 4794 | CA | ASN B | 260 | 14.851 | 40.351 | 62.697 | 1.00 | 0.00 | XXXX | 4794 |
| ATOM | 4795 | C | ASN B | 260 | 13.545 | 39.581 | 62.789 | 1.00 | 0.00 | XXXX | 4795 |
| ATOM | 4796 | O | ASN B | 260 | 13.052 | 39.288 | 63.880 | 1.00 | 0.00 | XXXX | 4796 |
| ATOM | 4797 | CB | ASN B | 260 | 14.683 | 41.750 | 63.289 | 1.00 | 0.00 | XXXX | 4797 |
| ATOM | 4798 | CG | ASN B | 260 | 15.913 | 42.614 | 63.104 | 1.00 | 0.00 | XXXX | 4798 |
| ATOM | 4799 | OD1 | ASN B | 260 | 15.853 | 43.674 | 62.481 | 1.00 | 0.00 | XXXX | 4799 |
| ATOM | 4800 | ND2 | ASN B | 260 | 17.039 | 42.164 | 63.645 | 1.00 | 0.00 | XXXX | 4800 |
| ATOM | 4801 | N | TYR B | 261 | 12.992 | 39.256 | 61.625 | 1.00 | 0.00 | XXXX | 4801 |
| ATOM | 4802 | CA | TYR B | 261 | 11.677 | 38.639 | 61.538 | 1.00 | 0.00 | XXXX | 4802 |
| ATOM | 4803 | C | TYR B | 261 | 11.530 | 37.796 | 60.276 | 1.00 | 0.00 | XXXX | 4803 |
| ATOM | 4804 | O | TYR B | 261 | 11.995 | 38.179 | 59.201 | 1.00 | 0.00 | XXXX | 4804 |
| ATOM | 4805 | CB | TYR B | 261 | 10.589 | 39.718 | 61.581 | 1.00 | 0.00 | XXXX | 4805 |
| ATOM | 4806 | CG | TYR B | 261 | 9.197 | 39.222 | 61.243 | 1.00 | 0.00 | XXXX | 4806 |
| ATOM | 4807 | CD1 | TYR B | 261 | 8.745 | 39.199 | 59.929 | 1.00 | 0.00 | XXXX | 4807 |
| ATOM | 4808 | CD2 | TYR B | 261 | 8.334 | 38.785 | 62.239 | 1.00 | 0.00 | XXXX | 4808 |
| ATOM | 4809 | CE1 | TYR B | 261 | 7.475 | 38.747 | 59.617 | 1.00 | 0.00 | XXXX | 4809 |
| ATOM | 4810 | CE2 | TYR B | 261 | 7.062 | 38.332 | 61.937 | 1.00 | 0.00 | XXXX | 4810 |
| ATOM | 4811 | CZ | TYR B | 261 | 6.637 | 38.316 | 60.625 | 1.00 | 0.00 | XXXX | 4811 |
| ATOM | 4812 | OH | TYR B | 261 | 5.371 | 37.866 | 60.321 | 1.00 | 0.00 | XXXX | 4812 |
| ATOM | 4813 | N | PHE B | 262 | 10.873 | 36.651 | 60.426 | 1.00 | 0.00 | XXXX | 4813 |
| ATOM | 4814 | CA | PHE B | 262 | 10.430 | 35.839 | 59.300 | 1.00 | 0.00 | XXXX | 4814 |
| ATOM | 4815 | C | PHE B | 262 | 8.943 | 35.566 | 59.466 | 1.00 | 0.00 | XXXX | 4815 |
| ATOM | 4816 | O | PHE B | 262 | 8.433 | 35.541 | 60.587 | 1.00 | 0.00 | XXXX | 4816 |
| ATOM | 4817 | CB | PHE B | 262 | 11.196 | 34.511 | 59.214 | 1.00 | 0.00 | XXXX | 4817 |
| ATOM | 4818 | CG | PHE B | 262 | 12.693 | 34.658 | 59.166 | 1.00 | 0.00 | XXXX | 4818 |
| ATOM | 4819 | CD1 | PHE B | 262 | 13.289 | 35.609 | 58.355 | 1.00 | 0.00 | XXXX | 4819 |
| ATOM | 4820 | CD2 | PHE B | 262 | 13.506 | 33.826 | 59.921 | 1.00 | 0.00 | XXXX | 4820 |
| ATOM | 4821 | CE1 | PHE B | 262 | 14.666 | 35.739 | 58.308 | 1.00 | 0.00 | XXXX | 4821 |
| ATOM | 4822 | CE2 | PHE B | 262 | 14.885 | 33.950 | 59.877 | 1.00 | 0.00 | XXXX | 4822 |
| ATOM | 4823 | CZ | PHE B | 262 | 15.466 | 34.907 | 59.069 | 1.00 | 0.00 | XXXX | 4823 |
| ATOM | 4824 | N | GLN B | 263 | 8.244 | 35.372 | 58.353 | 1.00 | 0.00 | XXXX | 4824 |
| ATOM | 4825 | CA | GLN B | 263 | 6.840 | 34.990 | 58.406 | 1.00 | 0.00 | XXXX | 4825 |
| ATOM | 4826 | C | GLN B | 263 | 6.675 | 33.690 | 59.191 | 1.00 | 0.00 | XXXX | 4826 |
| ATOM | 4827 | O | GLN B | 263 | 5.642 | 33.454 | 59.817 | 1.00 | 0.00 | XXXX | 4827 |
| ATOM | 4828 | CB | GLN B | 263 | 6.263 | 34.840 | 56.996 | 1.00 | 0.00 | XXXX | 4828 |
| ATOM | 4829 | CG | GLN B | 263 | 4.827 | 34.344 | 56.971 | 1.00 | 0.00 | XXXX | 4829 |
| ATOM | 4830 | CD | GLN B | 263 | 4.297 | 34.148 | 55.563 | 1.00 | 0.00 | XXXX | 4830 |
| ATOM | 4831 | OE1 | GLN B | 263 | 4.735 | 34.811 | 54.622 | 1.00 | 0.00 | XXXX | 4831 |
| ATOM | 4832 | NE2 | GLN B | 263 | 3.347 | 33.231 | 55.412 | 1.00 | 0.00 | XXXX | 4832 |
| ATOM | 4833 | N | SER B | 264 | 7.710 | 32.857 | 59.159 | 1.00 | 0.00 | XXXX | 4833 |
| ATOM | 4834 | CA | SER B | 264 | 7.665 | 31.537 | 59.781 | 1.00 | 0.00 | XXXX | 4834 |
| ATOM | 4835 | C | SER B | 264 | 7.914 | 31.569 | 61.290 | 1.00 | 0.00 | XXXX | 4835 |
| ATOM | 4836 | O | SER B | 264 | 7.927 | 30.524 | 61.939 | 1.00 | 0.00 | XXXX | 4836 |
| ATOM | 4837 | CB | SER B | 264 | 8.685 | 30.612 | 59.115 | 1.00 | 0.00 | XXXX | 4837 |
| ATOM | 4838 | OG | SER B | 264 | 9.993 | 31.148 | 59.214 | 1.00 | 0.00 | XXXX | 4838 |
| ATOM | 4839 | N | VAL B | 265 | 8.114 | 32.760 | 61.847 | 1.00 | 0.00 | XXXX | 4839 |
| ATOM | 4840 | CA | VAL B | 265 | 8.380 | 32.887 | 63.278 | 1.00 | 0.00 | XXXX | 4840 |
| ATOM | 4841 | C | VAL B | 265 | 7.211 | 32.370 | 64.109 | 1.00 | 0.00 | XXXX | 4841 |
| ATOM | 4842 | O | VAL B | 265 | 6.062 | 32.752 | 63.888 | 1.00 | 0.00 | XXXX | 4842 |
| ATOM | 4843 | CB | VAL B | 265 | 8.670 | 34.343 | 63.677 | 1.00 | 0.00 | XXXX | 4843 |
| ATOM | 4844 | CG1 | VAL B | 265 | 8.514 | 34.522 | 65.184 | 1.00 | 0.00 | XXXX | 4844 |
| ATOM | 4845 | CG2 | VAL B | 265 | 10.064 | 34.750 | 63.219 | 1.00 | 0.00 | XXXX | 4845 |
| ATOM | 4846 | N | ASP B | 266 | 7.515 | 31.502 | 65.069 | 1.00 | 0.00 | XXXX | 4846 |
| ATOM | 4847 | CA | ASP B | 266 | 6.483 | 30.851 | 65.867 | 1.00 | 0.00 | XXXX | 4847 |
| ATOM | 4848 | C | ASP B | 266 | 6.220 | 31.578 | 67.181 | 1.00 | 0.00 | XXXX | 4848 |
| ATOM | 4849 | O | ASP B | 266 | 6.785 | 31.237 | 68.219 | 1.00 | 0.00 | XXXX | 4849 |
| ATOM | 4850 | CB | ASP B | 266 | 6.866 | 29.397 | 66.148 | 1.00 | 0.00 | XXXX | 4850 |
| ATOM | 4851 | CG | ASP B | 266 | 5.786 | 28.646 | 66.903 | 1.00 | 0.00 | XXXX | 4851 |
| ATOM | 4852 | OD1 | ASP B | 266 | 4.601 | 29.018 | 66.777 | 1.00 | 0.00 | XXXX | 4852 |
| ATOM | 4853 | OD2 | ASP B | 266 | 6.123 | 27.682 | 67.623 | 1.00 | 0.00 | XXXX | 4853 |
| ATOM | 4854 | N | THR B | 267 | 5.360 | 32.587 | 67.124 | 1.00 | 0.00 | XXXX | 4854 |
| ATOM | 4855 | CA | THR B | 267 | 4.855 | 33.233 | 68.325 | 1.00 | 0.00 | XXXX | 4855 |
| ATOM | 4856 | C | THR B | 267 | 3.348 | 33.363 | 68.185 | 1.00 | 0.00 | XXXX | 4856 |
| ATOM | 4857 | O | THR B | 267 | 2.832 | 33.374 | 67.067 | 1.00 | 0.00 | XXXX | 4857 |
| ATOM | 4858 | CB | THR B | 267 | 5.477 | 34.625 | 68.551 | 1.00 | 0.00 | XXXX | 4858 |
| ATOM | 4859 | OG1 | THR B | 267 | 5.138 | 35.488 | 67.459 | 1.00 | 0.00 | XXXX | 4859 |
| ATOM | 4860 | CG2 | THR B | 267 | 6.992 | 34.528 | 68.670 | 1.00 | 0.00 | XXXX | 4860 |
| ATOM | 4861 | N | PRO B | 268 | 2.634 | 33.452 | 69.315 | 1.00 | 0.00 | XXXX | 4861 |
| ATOM | 4862 | CA | PRO B | 268 | 1.191 | 33.702 | 69.258 | 1.00 | 0.00 | XXXX | 4862 |
| ATOM | 4863 | C | PRO B | 268 | 0.912 | 35.013 | 68.534 | 1.00 | 0.00 | XXXX | 4863 |
| ATOM | 4864 | O | PRO B | 268 | −0.020 | 35.102 | 67.735 | 1.00 | 0.00 | XXXX | 4864 |
| ATOM | 4865 | CB | PRO B | 268 | 0.782 | 33.778 | 70.733 | 1.00 | 0.00 | XXXX | 4865 |
| ATOM | 4866 | CG | PRO B | 268 | 1.852 | 33.032 | 71.464 | 1.00 | 0.00 | XXXX | 4866 |
| ATOM | 4867 | CD | PRO B | 268 | 3.116 | 33.289 | 70.697 | 1.00 | 0.00 | XXXX | 4867 |
| ATOM | 4868 | N | GLU B | 269 | 1.735 | 36.018 | 68.818 | 1.00 | 0.00 | XXXX | 4868 |
| ATOM | 4869 | CA | GLU B | 269 | 1.617 | 37.324 | 68.182 | 1.00 | 0.00 | XXXX | 4869 |

-continued

| | | | | | | | | | | |
|---|---|---|---|---|---|---|---|---|---|---|
| ATOM | 4870 | C | GLU | B | 269 | 1.746 | 37.231 | 66.662 | 1.00 | 0.00 XXXX 4870 |
| ATOM | 4871 | O | GLU | B | 269 | 0.972 | 37.848 | 65.930 | 1.00 | 0.00 XXXX 4871 |
| ATOM | 4872 | CB | GLU | B | 269 | 2.671 | 38.283 | 68.740 | 1.00 | 0.00 XXXX 4872 |
| ATOM | 4873 | CG | GLU | B | 269 | 2.317 | 38.867 | 70.101 | 1.00 | 0.00 XXXX 4873 |
| ATOM | 4874 | CD | GLU | B | 269 | 2.566 | 37.897 | 71.241 | 1.00 | 0.00 XXXX 4874 |
| ATOM | 4875 | OE1 | GLU | B | 269 | 3.296 | 36.905 | 71.033 | 1.00 | 0.00 XXXX 4875 |
| ATOM | 4876 | OE2 | GLU | B | 269 | 2.031 | 38.128 | 72.347 | 1.00 | 0.00 XXXX 4876 |
| ATOM | 4877 | N | ASN | B | 270 | 2.723 | 36.463 | 66.187 | 1.00 | 0.00 XXXX 4877 |
| ATOM | 4878 | CA | ASN | B | 270 | 2.946 | 36.347 | 64.750 | 1.00 | 0.00 XXXX 4878 |
| ATOM | 4879 | C | ASN | B | 270 | 1.835 | 35.564 | 64.060 | 1.00 | 0.00 XXXX 4879 |
| ATOM | 4880 | O | ASN | B | 270 | 1.460 | 35.877 | 62.932 | 1.00 | 0.00 XXXX 4880 |
| ATOM | 4881 | CB | ASN | B | 270 | 4.294 | 35.690 | 64.458 | 1.00 | 0.00 XXXX 4881 |
| ATOM | 4882 | CG | ASN | B | 270 | 4.679 | 35.793 | 62.994 | 1.00 | 0.00 XXXX 4882 |
| ATOM | 4883 | OD1 | ASN | B | 270 | 4.361 | 36.779 | 62.328 | 1.00 | 0.00 XXXX 4883 |
| ATOM | 4884 | ND2 | ASN | B | 270 | 5.361 | 34.773 | 62.485 | 1.00 | 0.00 XXXX 4884 |
| ATOM | 4885 | N | LYS | B | 271 | 1.321 | 34.543 | 64.739 | 1.00 | 0.00 XXXX 4885 |
| ATOM | 4886 | CA | LYS | B | 271 | 0.199 | 33.768 | 64.222 | 1.00 | 0.00 XXXX 4886 |
| ATOM | 4887 | C | LYS | B | 271 | −0.983 | 34.678 | 63.905 | 1.00 | 0.00 XXXX 4887 |
| ATOM | 4888 | O | LYS | B | 271 | −1.582 | 34.587 | 62.833 | 1.00 | 0.00 XXXX 4888 |
| ATOM | 4889 | CB | LYS | B | 271 | −0.216 | 32.688 | 65.225 | 1.00 | 0.00 XXXX 4889 |
| ATOM | 4890 | CG | LYS | B | 271 | −1.345 | 31.785 | 64.743 | 1.00 | 0.00 XXXX 4890 |
| ATOM | 4891 | CD | LYS | B | 271 | −1.667 | 30.703 | 65.764 | 1.00 | 0.00 XXXX 4891 |
| ATOM | 4892 | CE | LYS | B | 271 | −2.936 | 29.946 | 65.396 | 1.00 | 0.00 XXXX 4892 |
| ATOM | 4893 | NZ | LYS | B | 271 | −2.805 | 29.221 | 64.101 | 1.00 | 0.00 XXXX 4893 |
| ATOM | 4894 | N | GLU | B | 272 | −1.309 | 35.554 | 64.851 | 1.00 | 0.00 XXXX 4894 |
| ATOM | 4895 | CA | GLU | B | 272 | −2.384 | 36.524 | 64.677 | 1.00 | 0.00 XXXX 4895 |
| ATOM | 4896 | C | GLU | B | 272 | −2.082 | 37.516 | 63.559 | 1.00 | 0.00 XXXX 4896 |
| ATOM | 4897 | O | GLU | B | 272 | −2.948 | 37.830 | 62.743 | 1.00 | 0.00 XXXX 4897 |
| ATOM | 4898 | CB | GLU | B | 272 | −2.641 | 37.274 | 65.987 | 1.00 | 0.00 XXXX 4898 |
| ATOM | 4899 | CG | GLU | B | 272 | −3.265 | 36.419 | 67.076 | 1.00 | 0.00 XXXX 4899 |
| ATOM | 4900 | CD | GLU | B | 272 | −4.590 | 35.818 | 66.650 | 1.00 | 0.00 XXXX 4900 |
| ATOM | 4901 | OE1 | GLU | B | 272 | −5.351 | 36.504 | 65.935 | 1.00 | 0.00 XXXX 4901 |
| ATOM | 4902 | OE2 | GLU | B | 272 | −4.869 | 34.660 | 67.026 | 1.00 | 0.00 XXXX 4902 |
| ATOM | 4903 | N | PHE | B | 273 | −0.847 | 38.006 | 63.530 | 1.00 | 0.00 XXXX 4903 |
| ATOM | 4904 | CA | PHE | B | 273 | −0.436 | 39.009 | 62.553 | 1.00 | 0.00 XXXX 4904 |
| ATOM | 4905 | C | PHE | B | 273 | −0.534 | 38.491 | 61.120 | 1.00 | 0.00 XXXX 4905 |
| ATOM | 4906 | O | PHE | B | 273 | −1.106 | 39.151 | 60.251 | 1.00 | 0.00 XXXX 4906 |
| ATOM | 4907 | CB | PHE | B | 273 | 0.993 | 39.471 | 62.848 | 1.00 | 0.00 XXXX 4907 |
| ATOM | 4908 | CG | PHE | B | 273 | 1.536 | 40.448 | 61.845 | 1.00 | 0.00 XXXX 4908 |
| ATOM | 4909 | CD1 | PHE | B | 273 | 0.898 | 41.655 | 61.616 | 1.00 | 0.00 XXXX 4909 |
| ATOM | 4910 | CD2 | PHE | B | 273 | 2.694 | 40.163 | 61.140 | 1.00 | 0.00 XXXX 4910 |
| ATOM | 4911 | CE1 | PHE | B | 273 | 1.398 | 42.556 | 60.696 | 1.00 | 0.00 XXXX 4911 |
| ATOM | 4912 | CE2 | PHE | B | 273 | 3.201 | 41.061 | 60.220 | 1.00 | 0.00 XXXX 4912 |
| ATOM | 4913 | CZ | PHE | B | 273 | 2.552 | 42.259 | 59.998 | 1.00 | 0.00 XXXX 4913 |
| ATOM | 4914 | N | VAL | B | 274 | 0.023 | 37.309 | 60.879 | 1.00 | 0.00 XXXX 4914 |
| ATOM | 4915 | CA | VAL | B | 274 | 0.000 | 36.708 | 59.550 | 1.00 | 0.00 XXXX 4915 |
| ATOM | 4916 | C | VAL | B | 274 | −1.428 | 36.376 | 59.126 | 1.00 | 0.00 XXXX 4916 |
| ATOM | 4917 | O | VAL | B | 274 | −1.801 | 36.568 | 57.968 | 1.00 | 0.00 XXXX 4917 |
| ATOM | 4918 | CB | VAL | B | 274 | 0.863 | 35.435 | 59.485 | 1.00 | 0.00 XXXX 4918 |
| ATOM | 4919 | CG1 | VAL | B | 274 | 0.703 | 34.756 | 58.134 | 1.00 | 0.00 XXXX 4919 |
| ATOM | 4920 | CG2 | VAL | B | 274 | 2.325 | 35.772 | 59.747 | 1.00 | 0.00 XXXX 4920 |
| ATOM | 4921 | N | GLU | B | 275 | −2.221 | 35.866 | 60.065 | 1.00 | 0.00 XXXX 4921 |
| ATOM | 4922 | CA | GLU | B | 275 | −3.624 | 35.573 | 59.796 | 1.00 | 0.00 XXXX 4922 |
| ATOM | 4923 | C | GLU | B | 275 | −4.378 | 36.831 | 59.375 | 1.00 | 0.00 XXXX 4923 |
| ATOM | 4924 | O | GLU | B | 275 | −5.126 | 36.815 | 58.396 | 1.00 | 0.00 XXXX 4924 |
| ATOM | 4925 | CB | GLU | B | 275 | −4.297 | 34.949 | 61.021 | 1.00 | 0.00 XXXX 4925 |
| ATOM | 4926 | CG | GLU | B | 275 | −4.027 | 33.462 | 61.203 | 1.00 | 0.00 XXXX 4926 |
| ATOM | 4927 | CD | GLU | B | 275 | −4.905 | 32.839 | 62.274 | 1.00 | 0.00 XXXX 4927 |
| ATOM | 4928 | OE1 | GLU | B | 275 | −5.968 | 33.418 | 62.583 | 1.00 | 0.00 XXXX 4928 |
| ATOM | 4929 | OE2 | GLU | B | 275 | −4.534 | 31.771 | 62.805 | 1.00 | 0.00 XXXX 4929 |
| ATOM | 4930 | N | LYS | B | 276 | −4.179 | 37.918 | 60.116 | 1.00 | 0.00 XXXX 4930 |
| ATOM | 4931 | CA | LYS | B | 276 | −4.855 | 39.180 | 59.819 | 1.00 | 0.00 XXXX 4931 |
| ATOM | 4932 | C | LYS | B | 276 | −4.406 | 39.790 | 58.492 | 1.00 | 0.00 XXXX 4932 |
| ATOM | 4933 | O | LYS | B | 276 | −5.228 | 40.294 | 57.726 | 1.00 | 0.00 XXXX 4933 |
| ATOM | 4934 | CB | LYS | B | 276 | −4.632 | 40.188 | 60.950 | 1.00 | 0.00 XXXX 4934 |
| ATOM | 4935 | CG | LYS | B | 276 | −5.471 | 39.923 | 62.189 | 1.00 | 0.00 XXXX 4935 |
| ATOM | 4936 | CD | LYS | B | 276 | −5.379 | 41.075 | 63.178 | 1.00 | 0.00 XXXX 4936 |
| ATOM | 4937 | CE | LYS | B | 276 | −3.988 | 41.193 | 63.774 | 1.00 | 0.00 XXXX 4937 |
| ATOM | 4938 | NZ | LYS | B | 276 | −3.928 | 42.245 | 64.826 | 1.00 | 0.00 XXXX 4938 |
| ATOM | 4939 | N | TYR | B | 277 | −3.103 | 39.749 | 58.229 | 1.00 | 0.00 XXXX 4939 |
| ATOM | 4940 | CA | TYR | B | 277 | −2.556 | 40.286 | 56.986 | 1.00 | 0.00 XXXX 4940 |
| ATOM | 4941 | C | TYR | B | 277 | −3.138 | 39.534 | 55.790 | 1.00 | 0.00 XXXX 4941 |
| ATOM | 4942 | O | TYR | B | 277 | −3.502 | 40.138 | 54.780 | 1.00 | 0.00 XXXX 4942 |
| ATOM | 4943 | CB | TYR | B | 277 | −1.026 | 40.197 | 56.991 | 1.00 | 0.00 XXXX 4943 |
| ATOM | 4944 | CG | TYR | B | 277 | −0.336 | 41.056 | 55.949 | 1.00 | 0.00 XXXX 4944 |
| ATOM | 4945 | CD1 | TYR | B | 277 | 0.089 | 40.516 | 54.741 | 1.00 | 0.00 XXXX 4945 |
| ATOM | 4946 | CD2 | TYR | B | 277 | −0.096 | 42.404 | 56.182 | 1.00 | 0.00 XXXX 4946 |
| ATOM | 4947 | CE1 | TYR | B | 277 | 0.727 | 41.297 | 53.791 | 1.00 | 0.00 XXXX 4947 |
| ATOM | 4948 | CE2 | TYR | B | 277 | 0.540 | 43.193 | 55.240 | 1.00 | 0.00 XXXX 4948 |

-continued

| | | | | | | | | | | |
|---|---|---|---|---|---|---|---|---|---|---|
| ATOM | 4949 | CZ | TYR B | 277 | 0.950 | 42.636 | 54.047 | 1.00 | 0.00 | XXXX | 4949 |
| ATOM | 4950 | OH | TYR B | 277 | 1.583 | 43.422 | 53.111 | 1.00 | 0.00 | XXXX | 4950 |
| ATOM | 4951 | N | LYS B | 278 | −3.229 | 38.214 | 55.916 | 1.00 | 0.00 | XXXX | 4951 |
| ATOM | 4952 | CA | LYS B | 278 | −3.764 | 37.374 | 54.850 | 1.00 | 0.00 | XXXX | 4952 |
| ATOM | 4953 | C | LYS B | 278 | −5.276 | 37.535 | 54.706 | 1.00 | 0.00 | XXXX | 4953 |
| ATOM | 4954 | O | LYS B | 278 | −5.806 | 37.522 | 53.594 | 1.00 | 0.00 | XXXX | 4954 |
| ATOM | 4955 | CB | LYS B | 278 | −3.417 | 35.905 | 55.099 | 1.00 | 0.00 | XXXX | 4955 |
| ATOM | 4956 | CG | LYS B | 278 | −1.955 | 35.559 | 54.855 | 1.00 | 0.00 | XXXX | 4956 |
| ATOM | 4957 | CD | LYS B | 278 | −1.670 | 34.106 | 55.202 | 1.00 | 0.00 | XXXX | 4957 |
| ATOM | 4958 | CE | LYS B | 278 | −0.232 | 33.730 | 54.890 | 1.00 | 0.00 | XXXX | 4958 |
| ATOM | 4959 | NZ | LYS B | 278 | 0.027 | 33.708 | 53.423 | 1.00 | 0.00 | XXXX | 4959 |
| ATOM | 4960 | N | LYS B | 279 | −5.967 | 37.683 | 55.832 | 1.00 | 0.00 | XXXX | 4960 |
| ATOM | 4961 | CA | LYS B | 279 | −7.410 | 37.899 | 55.809 | 1.00 | 0.00 | XXXX | 4961 |
| ATOM | 4962 | C | LYS B | 279 | −7.761 | 39.182 | 55.059 | 1.00 | 0.00 | XXXX | 4962 |
| ATOM | 4963 | O | LYS B | 279 | −8.744 | 39.230 | 54.319 | 1.00 | 0.00 | XXXX | 4963 |
| ATOM | 4964 | CB | LYS B | 279 | −7.974 | 37.949 | 57.231 | 1.00 | 0.00 | XXXX | 4964 |
| ATOM | 4965 | CG | LYS B | 279 | −9.471 | 38.218 | 57.284 | 1.00 | 0.00 | XXXX | 4965 |
| ATOM | 4966 | CD | LYS B | 279 | −9.997 | 38.220 | 58.712 | 1.00 | 0.00 | XXXX | 4966 |
| ATOM | 4967 | CE | LYS B | 279 | −11.476 | 38.583 | 58.753 | 1.00 | 0.00 | XXXX | 4967 |
| ATOM | 4968 | NZ | LYS B | 279 | −12.039 | 38.486 | 60.129 | 1.00 | 0.00 | XXXX | 4968 |
| ATOM | 4969 | N | LYS B | 280 | −6.955 | 40.220 | 55.251 | 1.00 | 0.00 | XXXX | 4969 |
| ATOM | 4970 | CA | LYS B | 280 | −7.212 | 41.504 | 54.608 | 1.00 | 0.00 | XXXX | 4970 |
| ATOM | 4971 | C | LYS B | 280 | −6.781 | 41.535 | 53.143 | 1.00 | 0.00 | XXXX | 4971 |
| ATOM | 4972 | O | LYS B | 280 | −7.499 | 42.062 | 52.294 | 1.00 | 0.00 | XXXX | 4972 |
| ATOM | 4973 | CB | LYS B | 280 | −6.516 | 42.636 | 55.367 | 1.00 | 0.00 | XXXX | 4973 |
| ATOM | 4974 | CG | LYS B | 280 | −6.863 | 44.017 | 54.827 | 1.00 | 0.00 | XXXX | 4974 |
| ATOM | 4975 | CD | LYS B | 280 | −6.317 | 45.129 | 55.702 | 1.00 | 0.00 | XXXX | 4975 |
| ATOM | 4976 | CE | LYS B | 280 | −6.678 | 46.495 | 55.134 | 1.00 | 0.00 | XXXX | 4976 |
| ATOM | 4977 | NZ | LYS B | 280 | −8.145 | 46.635 | 54.908 | 1.00 | 0.00 | XXXX | 4977 |
| ATOM | 4978 | N | TYR B | 281 | −5.612 | 40.976 | 52.846 | 1.00 | 0.00 | XXXX | 4978 |
| ATOM | 4979 | CA | TYR B | 281 | −5.025 | 41.132 | 51.518 | 1.00 | 0.00 | XXXX | 4979 |
| ATOM | 4980 | C | TYR B | 281 | −4.997 | 39.852 | 50.680 | 1.00 | 0.00 | XXXX | 4980 |
| ATOM | 4981 | O | TYR B | 281 | −4.686 | 39.900 | 49.491 | 1.00 | 0.00 | XXXX | 4981 |
| ATOM | 4982 | CB | TYR B | 281 | −3.606 | 41.693 | 51.643 | 1.00 | 0.00 | XXXX | 4982 |
| ATOM | 4983 | CG | TYR B | 281 | −3.566 | 43.083 | 52.237 | 1.00 | 0.00 | XXXX | 4983 |
| ATOM | 4984 | CD1 | TYR B | 281 | −4.176 | 44.150 | 51.590 | 1.00 | 0.00 | XXXX | 4984 |
| ATOM | 4985 | CD2 | TYR B | 281 | −2.927 | 43.329 | 53.446 | 1.00 | 0.00 | XXXX | 4985 |
| ATOM | 4986 | CE1 | TYR B | 281 | −4.149 | 45.422 | 52.125 | 1.00 | 0.00 | XXXX | 4986 |
| ATOM | 4987 | CE2 | TYR B | 281 | −2.894 | 44.601 | 53.990 | 1.00 | 0.00 | XXXX | 4987 |
| ATOM | 4988 | CZ | TYR B | 281 | −3.508 | 45.643 | 53.324 | 1.00 | 0.00 | XXXX | 4988 |
| ATOM | 4989 | OH | TYR B | 281 | −3.481 | 46.912 | 53.855 | 1.00 | 0.00 | XXXX | 4989 |
| ATOM | 4990 | N | GLY B | 282 | −5.314 | 38.712 | 51.286 | 1.00 | 0.00 | XXXX | 4990 |
| ATOM | 4991 | CA | GLY B | 282 | −5.362 | 37.467 | 50.538 | 1.00 | 0.00 | XXXX | 4991 |
| ATOM | 4992 | C | GLY B | 282 | −4.461 | 36.373 | 51.083 | 1.00 | 0.00 | XXXX | 4992 |
| ATOM | 4993 | O | GLY B | 282 | −3.369 | 36.644 | 51.581 | 1.00 | 0.00 | XXXX | 4993 |
| ATOM | 4994 | N | GLU B | 283 | −4.922 | 35.131 | 50.982 | 1.00 | 0.00 | XXXX | 4994 |
| ATOM | 4995 | CA | GLU B | 283 | −4.202 | 33.990 | 51.539 | 1.00 | 0.00 | XXXX | 4995 |
| ATOM | 4996 | C | GLU B | 283 | −2.855 | 33.733 | 50.863 | 1.00 | 0.00 | XXXX | 4996 |
| ATOM | 4997 | O | GLU B | 283 | −2.007 | 33.025 | 51.407 | 1.00 | 0.00 | XXXX | 4997 |
| ATOM | 4998 | CB | GLU B | 283 | −5.070 | 32.734 | 51.450 | 1.00 | 0.00 | XXXX | 4998 |
| ATOM | 4999 | CG | GLU B | 283 | −6.161 | 32.659 | 52.507 | 1.00 | 0.00 | XXXX | 4999 |
| ATOM | 5000 | CD | GLU B | 283 | −5.611 | 32.692 | 53.923 | 1.00 | 0.00 | XXXX | 5000 |
| ATOM | 5001 | OE1 | GLU B | 283 | −4.630 | 31.971 | 54.199 | 1.00 | 0.00 | XXXX | 5001 |
| ATOM | 5002 | OE2 | GLU B | 283 | −6.162 | 33.436 | 54.763 | 1.00 | 0.00 | XXXX | 5002 |
| ATOM | 5003 | N | ASP B | 284 | −2.666 | 34.307 | 49.679 | 1.00 | 0.00 | XXXX | 5003 |
| ATOM | 5004 | CA | ASP B | 284 | −1.422 | 34.140 | 48.938 | 1.00 | 0.00 | XXXX | 5004 |
| ATOM | 5005 | C | ASP B | 284 | −0.352 | 35.139 | 49.382 | 1.00 | 0.00 | XXXX | 5005 |
| ATOM | 5006 | O | ASP B | 284 | 0.837 | 34.941 | 49.127 | 1.00 | 0.00 | XXXX | 5006 |
| ATOM | 5007 | CB | ASP B | 284 | −1.676 | 34.270 | 47.429 | 1.00 | 0.00 | XXXX | 5007 |
| ATOM | 5008 | CG | ASP B | 284 | −2.114 | 32.956 | 46.796 | 1.00 | 0.00 | XXXX | 5008 |
| ATOM | 5009 | OD1 | ASP B | 284 | −2.455 | 32.017 | 47.549 | 1.00 | 0.00 | XXXX | 5009 |
| ATOM | 5010 | OD2 | ASP B | 284 | −2.105 | 32.860 | 45.551 | 1.00 | 0.00 | XXXX | 5010 |
| ATOM | 5011 | N | ARG B | 285 | −0.780 | 36.202 | 50.055 | 1.00 | 0.00 | XXXX | 5011 |
| ATOM | 5012 | CA | ARG B | 285 | 0.130 | 37.264 | 50.477 | 1.00 | 0.00 | XXXX | 5012 |
| ATOM | 5013 | C | ARG B | 285 | 1.057 | 36.805 | 51.599 | 1.00 | 0.00 | XXXX | 5013 |
| ATOM | 5014 | O | ARG B | 285 | 0.658 | 36.038 | 52.475 | 1.00 | 0.00 | XXXX | 5014 |
| ATOM | 5015 | CB | ARG B | 285 | −0.660 | 38.496 | 50.926 | 1.00 | 0.00 | XXXX | 5015 |
| ATOM | 5016 | CG | ARG B | 285 | −1.437 | 39.190 | 49.816 | 1.00 | 0.00 | XXXX | 5016 |
| ATOM | 5017 | CD | ARG B | 285 | −0.511 | 39.914 | 48.845 | 1.00 | 0.00 | XXXX | 5017 |
| ATOM | 5018 | NE | ARG B | 285 | 0.232 | 40.999 | 49.484 | 1.00 | 0.00 | XXXX | 5018 |
| ATOM | 5019 | CZ | ARG B | 285 | −0.186 | 42.261 | 49.547 | 1.00 | 0.00 | XXXX | 5019 |
| ATOM | 5020 | NH1 | ARG B | 285 | −1.352 | 42.606 | 49.018 | 1.00 | 0.00 | XXXX | 5020 |
| ATOM | 5021 | NH2 | ARG B | 285 | 0.561 | 43.179 | 50.148 | 1.00 | 0.00 | XXXX | 5021 |
| ATOM | 5022 | N | VAL B | 286 | 2.299 | 37.278 | 51.565 | 1.00 | 0.00 | XXXX | 5022 |
| ATOM | 5023 | CA | VAL B | 286 | 3.275 | 36.946 | 52.596 | 1.00 | 0.00 | XXXX | 5023 |
| ATOM | 5024 | C | VAL B | 286 | 3.578 | 38.139 | 53.490 | 1.00 | 0.00 | XXXX | 5024 |
| ATOM | 5025 | O | VAL B | 286 | 3.252 | 39.278 | 53.157 | 1.00 | 0.00 | XXXX | 5025 |
| ATOM | 5026 | CB | VAL B | 286 | 4.598 | 36.448 | 51.986 | 1.00 | 0.00 | XXXX | 5026 |
| ATOM | 5027 | CG1 | VAL B | 286 | 4.367 | 35.180 | 51.183 | 1.00 | 0.00 | XXXX | 5027 |

| | | | | | | | | | | |
|---|---|---|---|---|---|---|---|---|---|---|
| ATOM | 5028 | CG2 | VAL B | 286 | 5.227 | 37.534 | 51.122 | 1.00 | 0.00 | XXXX | 5028 |
| ATOM | 5029 | N | THR B | 287 | 4.197 | 37.867 | 54.634 | 1.00 | 0.00 | XXXX | 5029 |
| ATOM | 5030 | CA | THR B | 287 | 4.745 | 38.923 | 55.470 | 1.00 | 0.00 | XXXX | 5030 |
| ATOM | 5031 | C | THR B | 287 | 6.259 | 38.768 | 55.528 | 1.00 | 0.00 | XXXX | 5031 |
| ATOM | 5032 | O | THR B | 287 | 6.792 | 37.702 | 55.222 | 1.00 | 0.00 | XXXX | 5032 |
| ATOM | 5033 | CB | THR B | 287 | 4.175 | 38.895 | 56.900 | 1.00 | 0.00 | XXXX | 5033 |
| ATOM | 5034 | OG1 | THR B | 287 | 4.545 | 37.670 | 57.545 | 1.00 | 0.00 | XXXX | 5034 |
| ATOM | 5035 | CG2 | THR B | 287 | 2.656 | 39.025 | 56.879 | 1.00 | 0.00 | XXXX | 5035 |
| ATOM | 5036 | N | ASP B | 288 | 6.948 | 39.833 | 55.922 | 1.00 | 0.00 | XXXX | 5036 |
| ATOM | 5037 | CA | ASP B | 288 | 8.387 | 39.774 | 56.140 | 1.00 | 0.00 | XXXX | 5037 |
| ATOM | 5038 | C | ASP B | 288 | 8.830 | 40.892 | 57.078 | 1.00 | 0.00 | XXXX | 5038 |
| ATOM | 5039 | O | ASP B | 288 | 7.999 | 41.633 | 57.603 | 1.00 | 0.00 | XXXX | 5039 |
| ATOM | 5040 | CB | ASP B | 288 | 9.152 | 39.825 | 54.807 | 1.00 | 0.00 | XXXX | 5040 |
| ATOM | 5041 | CG | ASP B | 288 | 8.927 | 41.116 | 54.029 | 1.00 | 0.00 | XXXX | 5041 |
| ATOM | 5042 | OD1 | ASP B | 288 | 8.453 | 42.115 | 54.605 | 1.00 | 0.00 | XXXX | 5042 |
| ATOM | 5043 | OD2 | ASP B | 288 | 9.242 | 41.129 | 52.819 | 1.00 | 0.00 | XXXX | 5043 |
| ATOM | 5044 | N | ASP B | 289 | 10.137 | 41.003 | 57.286 | 1.00 | 0.00 | XXXX | 5044 |
| ATOM | 5045 | CA | ASP B | 289 | 10.684 | 41.906 | 58.295 | 1.00 | 0.00 | XXXX | 5045 |
| ATOM | 5046 | C | ASP B | 289 | 10.245 | 43.355 | 58.067 | 1.00 | 0.00 | XXXX | 5046 |
| ATOM | 5047 | O | ASP B | 289 | 9.675 | 43.975 | 58.966 | 1.00 | 0.00 | XXXX | 5047 |
| ATOM | 5048 | CB | ASP B | 289 | 12.215 | 41.799 | 58.313 | 1.00 | 0.00 | XXXX | 5048 |
| ATOM | 5049 | CG | ASP B | 289 | 12.862 | 42.702 | 59.351 | 1.00 | 0.00 | XXXX | 5049 |
| ATOM | 5050 | OD1 | ASP B | 289 | 13.539 | 42.169 | 60.254 | 1.00 | 0.00 | XXXX | 5050 |
| ATOM | 5051 | OD2 | ASP B | 289 | 12.719 | 43.937 | 59.256 | 1.00 | 0.00 | XXXX | 5051 |
| ATOM | 5052 | N | PRO B | 290 | 10.501 | 43.897 | 56.865 | 1.00 | 0.00 | XXXX | 5052 |
| ATOM | 5053 | CA | PRO B | 290 | 10.092 | 45.272 | 56.554 | 1.00 | 0.00 | XXXX | 5053 |
| ATOM | 5054 | C | PRO B | 290 | 8.593 | 45.492 | 56.738 | 1.00 | 0.00 | XXXX | 5054 |
| ATOM | 5055 | O | PRO B | 290 | 8.177 | 46.540 | 57.231 | 1.00 | 0.00 | XXXX | 5055 |
| ATOM | 5056 | CB | PRO B | 290 | 10.488 | 45.429 | 55.084 | 1.00 | 0.00 | XXXX | 5056 |
| ATOM | 5057 | CG | PRO B | 290 | 11.617 | 44.474 | 54.903 | 1.00 | 0.00 | XXXX | 5057 |
| ATOM | 5058 | CD | PRO B | 290 | 11.277 | 43.294 | 55.766 | 1.00 | 0.00 | XXXX | 5058 |
| ATOM | 5059 | N | ILE B | 291 | 7.796 | 44.504 | 56.346 | 1.00 | 0.00 | XXXX | 5059 |
| ATOM | 5060 | CA | ILE B | 291 | 6.351 | 44.575 | 56.522 | 1.00 | 0.00 | XXXX | 5060 |
| ATOM | 5061 | C | ILE B | 291 | 5.976 | 44.645 | 58.004 | 1.00 | 0.00 | XXXX | 5061 |
| ATOM | 5062 | O | ILE B | 291 | 5.087 | 45.405 | 58.389 | 1.00 | 0.00 | XXXX | 5062 |
| ATOM | 5063 | CB | ILE B | 291 | 5.649 | 43.376 | 55.868 | 1.00 | 0.00 | XXXX | 5063 |
| ATOM | 5064 | CG1 | ILE B | 291 | 5.678 | 43.516 | 54.343 | 1.00 | 0.00 | XXXX | 5064 |
| ATOM | 5065 | CG2 | ILE B | 291 | 4.218 | 43.258 | 56.367 | 1.00 | 0.00 | XXXX | 5065 |
| ATOM | 5066 | CD1 | ILE B | 291 | 5.241 | 42.268 | 53.607 | 1.00 | 0.00 | XXXX | 5066 |
| ATOM | 5067 | N | GLU B | 292 | 6.653 | 43.855 | 58.832 | 1.00 | 0.00 | XXXX | 5067 |
| ATOM | 5068 | CA | GLU B | 292 | 6.410 | 43.895 | 60.271 | 1.00 | 0.00 | XXXX | 5068 |
| ATOM | 5069 | C | GLU B | 292 | 6.814 | 45.245 | 60.851 | 1.00 | 0.00 | XXXX | 5069 |
| ATOM | 5070 | O | GLU B | 292 | 6.115 | 45.803 | 61.697 | 1.00 | 0.00 | XXXX | 5070 |
| ATOM | 5071 | CB | GLU B | 292 | 7.164 | 42.779 | 60.997 | 1.00 | 0.00 | XXXX | 5071 |
| ATOM | 5072 | CG | GLU B | 292 | 6.779 | 42.670 | 62.467 | 1.00 | 0.00 | XXXX | 5072 |
| ATOM | 5073 | CD | GLU B | 292 | 7.937 | 42.270 | 63.361 | 1.00 | 0.00 | XXXX | 5073 |
| ATOM | 5074 | OE1 | GLU B | 292 | 7.680 | 41.863 | 64.513 | 1.00 | 0.00 | XXXX | 5074 |
| ATOM | 5075 | OE2 | GLU B | 292 | 9.102 | 42.380 | 62.922 | 1.00 | 0.00 | XXXX | 5075 |
| ATOM | 5076 | N | ALA B | 293 | 7.956 | 45.758 | 60.400 | 1.00 | 0.00 | XXXX | 5076 |
| ATOM | 5077 | CA | ALA B | 293 | 8.486 | 47.017 | 60.910 | 1.00 | 0.00 | XXXX | 5077 |
| ATOM | 5078 | C | ALA B | 293 | 7.555 | 48.182 | 60.597 | 1.00 | 0.00 | XXXX | 5078 |
| ATOM | 5079 | O | ALA B | 293 | 7.359 | 49.069 | 61.427 | 1.00 | 0.00 | XXXX | 5079 |
| ATOM | 5080 | CB | ALA B | 293 | 9.870 | 47.278 | 60.337 | 1.00 | 0.00 | XXXX | 5080 |
| ATOM | 5081 | N | ALA B | 294 | 6.983 | 48.174 | 59.397 | 1.00 | 0.00 | XXXX | 5081 |
| ATOM | 5082 | CA | ALA B | 294 | 6.046 | 49.215 | 58.992 | 1.00 | 0.00 | XXXX | 5082 |
| ATOM | 5083 | C | ALA B | 294 | 4.790 | 49.155 | 59.852 | 1.00 | 0.00 | XXXX | 5083 |
| ATOM | 5084 | O | ALA B | 294 | 4.286 | 50.179 | 60.312 | 1.00 | 0.00 | XXXX | 5084 |
| ATOM | 5085 | CB | ALA B | 294 | 5.691 | 49.072 | 57.523 | 1.00 | 0.00 | XXXX | 5085 |
| ATOM | 5086 | N | TYR B | 295 | 4.295 | 47.939 | 60.059 | 1.00 | 0.00 | XXXX | 5086 |
| ATOM | 5087 | CA | TYR B | 295 | 3.128 | 47.694 | 60.898 | 1.00 | 0.00 | XXXX | 5087 |
| ATOM | 5088 | C | TYR B | 295 | 3.402 | 48.116 | 62.339 | 1.00 | 0.00 | XXXX | 5088 |
| ATOM | 5089 | O | TYR B | 295 | 2.611 | 48.837 | 62.949 | 1.00 | 0.00 | XXXX | 5089 |
| ATOM | 5090 | CB | TYR B | 295 | 2.744 | 46.215 | 60.833 | 1.00 | 0.00 | XXXX | 5090 |
| ATOM | 5091 | CG | TYR B | 295 | 1.605 | 45.802 | 61.741 | 1.00 | 0.00 | XXXX | 5091 |
| ATOM | 5092 | CD1 | TYR B | 295 | 1.854 | 45.222 | 62.977 | 1.00 | 0.00 | XXXX | 5092 |
| ATOM | 5093 | CD2 | TYR B | 295 | 0.282 | 45.977 | 61.354 | 1.00 | 0.00 | XXXX | 5093 |
| ATOM | 5094 | CE1 | TYR B | 295 | 0.821 | 44.833 | 63.806 | 1.00 | 0.00 | XXXX | 5094 |
| ATOM | 5095 | CE2 | TYR B | 295 | −0.760 | 45.591 | 62.176 | 1.00 | 0.00 | XXXX | 5095 |
| ATOM | 5096 | CZ | TYR B | 295 | −0.484 | 45.019 | 63.402 | 1.00 | 0.00 | XXXX | 5096 |
| ATOM | 5097 | OH | TYR B | 295 | −1.516 | 44.633 | 64.226 | 1.00 | 0.00 | XXXX | 5097 |
| ATOM | 5098 | N | ILE B | 296 | 4.526 | 47.646 | 62.873 | 1.00 | 0.00 | XXXX | 5098 |
| ATOM | 5099 | CA | ILE B | 296 | 4.981 | 48.012 | 64.210 | 1.00 | 0.00 | XXXX | 5099 |
| ATOM | 5100 | C | ILE B | 296 | 5.103 | 49.523 | 64.389 | 1.00 | 0.00 | XXXX | 5100 |
| ATOM | 5101 | O | ILE B | 296 | 4.692 | 50.072 | 65.413 | 1.00 | 0.00 | XXXX | 5101 |
| ATOM | 5102 | CB | ILE B | 296 | 6.348 | 47.370 | 64.525 | 1.00 | 0.00 | XXXX | 5102 |
| ATOM | 5103 | CG1 | ILE B | 296 | 6.179 | 45.893 | 64.885 | 1.00 | 0.00 | XXXX | 5103 |
| ATOM | 5104 | CG2 | ILE B | 296 | 7.053 | 48.128 | 65.642 | 1.00 | 0.00 | XXXX | 5104 |
| ATOM | 5105 | CD1 | ILE B | 296 | 7.484 | 45.201 | 65.203 | 1.00 | 0.00 | XXXX | 5105 |
| ATOM | 5106 | N | GLY B | 297 | 5.675 | 50.186 | 63.389 | 1.00 | 0.00 | XXXX | 5106 |

-continued

| | | | | | | | | | | |
|---|---|---|---|---|---|---|---|---|---|---|
| ATOM | 5107 | CA | GLY B | 297 | 5.912 | 51.617 | 63.446 | 1.00 | 0.00 | XXXX | 5107 |
| ATOM | 5108 | C | GLY B | 297 | 4.657 | 52.430 | 63.701 | 1.00 | 0.00 | XXXX | 5108 |
| ATOM | 5109 | O | GLY B | 297 | 4.677 | 53.384 | 64.476 | 1.00 | 0.00 | XXXX | 5109 |
| ATOM | 5110 | N | VAL B | 298 | 3.563 | 52.055 | 63.046 | 1.00 | 0.00 | XXXX | 5110 |
| ATOM | 5111 | CA | VAL B | 298 | 2.292 | 52.747 | 63.230 | 1.00 | 0.00 | XXXX | 5111 |
| ATOM | 5112 | C | VAL B | 298 | 1.792 | 52.613 | 64.667 | 1.00 | 0.00 | XXXX | 5112 |
| ATOM | 5113 | O | VAL B | 298 | 1.358 | 53.591 | 65.276 | 1.00 | 0.00 | XXXX | 5113 |
| ATOM | 5114 | CB | VAL B | 298 | 1.214 | 52.215 | 62.268 | 1.00 | 0.00 | XXXX | 5114 |
| ATOM | 5115 | CG1 | VAL B | 298 | −0.133 | 52.854 | 62.574 | 1.00 | 0.00 | XXXX | 5115 |
| ATOM | 5116 | CG2 | VAL B | 298 | 1.620 | 52.471 | 60.822 | 1.00 | 0.00 | XXXX | 5116 |
| ATOM | 5117 | N | TYR B | 299 | 1.857 | 51.399 | 65.203 | 1.00 | 0.00 | XXXX | 5117 |
| ATOM | 5118 | CA | TYR B | 299 | 1.417 | 51.146 | 66.569 | 1.00 | 0.00 | XXXX | 5118 |
| ATOM | 5119 | C | TYR B | 299 | 2.276 | 51.877 | 67.596 | 1.00 | 0.00 | XXXX | 5119 |
| ATOM | 5120 | O | TYR B | 299 | 1.761 | 52.392 | 68.586 | 1.00 | 0.00 | XXXX | 5120 |
| ATOM | 5121 | CB | TYR B | 299 | 1.410 | 49.644 | 66.864 | 1.00 | 0.00 | XXXX | 5121 |
| ATOM | 5122 | CG | TYR B | 299 | 0.078 | 48.994 | 66.575 | 1.00 | 0.00 | XXXX | 5122 |
| ATOM | 5123 | CD1 | TYR B | 299 | −0.154 | 48.340 | 65.373 | 1.00 | 0.00 | XXXX | 5123 |
| ATOM | 5124 | CD2 | TYR B | 299 | −0.957 | 49.053 | 67.500 | 1.00 | 0.00 | XXXX | 5124 |
| ATOM | 5125 | CE1 | TYR B | 299 | −1.378 | 47.752 | 65.106 | 1.00 | 0.00 | XXXX | 5125 |
| ATOM | 5126 | CE2 | TYR B | 299 | −2.182 | 48.468 | 67.242 | 1.00 | 0.00 | XXXX | 5126 |
| ATOM | 5127 | CZ | TYR B | 299 | −2.388 | 47.820 | 66.043 | 1.00 | 0.00 | XXXX | 5127 |
| ATOM | 5128 | OH | TYR B | 299 | −3.608 | 47.237 | 65.780 | 1.00 | 0.00 | XXXX | 5128 |
| ATOM | 5129 | N | LEU B | 300 | 3.583 | 51.923 | 67.359 | 1.00 | 0.00 | XXXX | 5129 |
| ATOM | 5130 | CA | LEU B | 300 | 4.488 | 52.569 | 68.303 | 1.00 | 0.00 | XXXX | 5130 |
| ATOM | 5131 | C | LEU B | 300 | 4.295 | 54.084 | 68.324 | 1.00 | 0.00 | XXXX | 5131 |
| ATOM | 5132 | O | LEU B | 300 | 4.319 | 54.699 | 69.390 | 1.00 | 0.00 | XXXX | 5132 |
| ATOM | 5133 | CB | LEU B | 300 | 5.941 | 52.221 | 67.980 | 1.00 | 0.00 | XXXX | 5133 |
| ATOM | 5134 | CG | LEU B | 300 | 6.383 | 50.840 | 68.473 | 1.00 | 0.00 | XXXX | 5134 |
| ATOM | 5135 | CD1 | LEU B | 300 | 7.773 | 50.495 | 67.965 | 1.00 | 0.00 | XXXX | 5135 |
| ATOM | 5136 | CD2 | LEU B | 300 | 6.324 | 50.761 | 69.996 | 1.00 | 0.00 | XXXX | 5136 |
| ATOM | 5137 | N | TRP B | 301 | 4.106 | 54.687 | 67.153 | 1.00 | 0.00 | XXXX | 5137 |
| ATOM | 5138 | CA | TRP B | 301 | 3.789 | 56.111 | 67.088 | 1.00 | 0.00 | XXXX | 5138 |
| ATOM | 5139 | C | TRP B | 301 | 2.499 | 56.420 | 67.836 | 1.00 | 0.00 | XXXX | 5139 |
| ATOM | 5140 | O | TRP B | 301 | 2.432 | 57.370 | 68.618 | 1.00 | 0.00 | XXXX | 5140 |
| ATOM | 5141 | CB | TRP B | 301 | 3.663 | 56.588 | 65.642 | 1.00 | 0.00 | XXXX | 5141 |
| ATOM | 5142 | CG | TRP B | 301 | 3.075 | 57.967 | 65.545 | 1.00 | 0.00 | XXXX | 5142 |
| ATOM | 5143 | CD1 | TRP B | 301 | 3.727 | 59.151 | 65.734 | 1.00 | 0.00 | XXXX | 5143 |
| ATOM | 5144 | CD2 | TRP B | 301 | 1.712 | 58.302 | 65.253 | 1.00 | 0.00 | XXXX | 5144 |
| ATOM | 5145 | NE1 | TRP B | 301 | 2.857 | 60.202 | 65.572 | 1.00 | 0.00 | XXXX | 5145 |
| ATOM | 5146 | CE2 | TRP B | 301 | 1.615 | 59.708 | 65.275 | 1.00 | 0.00 | XXXX | 5146 |
| ATOM | 5147 | CE3 | TRP B | 301 | 0.567 | 57.551 | 64.969 | 1.00 | 0.00 | XXXX | 5147 |
| ATOM | 5148 | CZ2 | TRP B | 301 | 0.417 | 60.378 | 65.026 | 1.00 | 0.00 | XXXX | 5148 |
| ATOM | 5149 | CZ3 | TRP B | 301 | −0.620 | 58.219 | 64.722 | 1.00 | 0.00 | XXXX | 5149 |
| ATOM | 5150 | CH2 | TRP B | 301 | −0.685 | 59.618 | 64.750 | 1.00 | 0.00 | XXXX | 5150 |
| ATOM | 5151 | N | ALA B | 302 | 1.473 | 55.617 | 67.580 | 1.00 | 0.00 | XXXX | 5151 |
| ATOM | 5152 | CA | ALA B | 302 | 0.167 | 55.825 | 68.189 | 1.00 | 0.00 | XXXX | 5152 |
| ATOM | 5153 | C | ALA B | 302 | 0.247 | 55.700 | 69.708 | 1.00 | 0.00 | XXXX | 5153 |
| ATOM | 5154 | O | ALA B | 302 | −0.391 | 56.461 | 70.435 | 1.00 | 0.00 | XXXX | 5154 |
| ATOM | 5155 | CB | ALA B | 302 | −0.845 | 54.842 | 67.623 | 1.00 | 0.00 | XXXX | 5155 |
| ATOM | 5156 | N | LYS B | 303 | 1.037 | 54.740 | 70.182 | 1.00 | 0.00 | XXXX | 5156 |
| ATOM | 5157 | CA | LYS B | 303 | 1.243 | 54.560 | 71.614 | 1.00 | 0.00 | XXXX | 5157 |
| ATOM | 5158 | C | LYS B | 303 | 1.957 | 55.764 | 72.226 | 1.00 | 0.00 | XXXX | 5158 |
| ATOM | 5159 | O | LYS B | 303 | 1.640 | 56.184 | 73.339 | 1.00 | 0.00 | XXXX | 5159 |
| ATOM | 5160 | CB | LYS B | 303 | 2.034 | 53.278 | 71.890 | 1.00 | 0.00 | XXXX | 5160 |
| ATOM | 5161 | CG | LYS B | 303 | 1.269 | 52.003 | 71.569 | 1.00 | 0.00 | XXXX | 5161 |
| ATOM | 5162 | CD | LYS B | 303 | 2.013 | 50.765 | 72.045 | 1.00 | 0.00 | XXXX | 5162 |
| ATOM | 5163 | CE | LYS B | 303 | 2.153 | 50.763 | 73.560 | 1.00 | 0.00 | XXXX | 5163 |
| ATOM | 5164 | NZ | LYS B | 303 | 2.666 | 49.466 | 74.079 | 1.00 | 0.00 | XXXX | 5164 |
| ATOM | 5165 | N | ALA B | 304 | 2.925 | 56.313 | 71.498 | 1.00 | 0.00 | XXXX | 5165 |
| ATOM | 5166 | CA | ALA B | 304 | 3.642 | 57.497 | 71.963 | 1.00 | 0.00 | XXXX | 5166 |
| ATOM | 5167 | C | ALA B | 304 | 2.715 | 58.707 | 72.051 | 1.00 | 0.00 | XXXX | 5167 |
| ATOM | 5168 | O | ALA B | 304 | 2.787 | 59.490 | 72.999 | 1.00 | 0.00 | XXXX | 5168 |
| ATOM | 5169 | CB | ALA B | 304 | 4.821 | 57.795 | 71.050 | 1.00 | 0.00 | XXXX | 5169 |
| ATOM | 5170 | N | VAL B | 305 | 1.840 | 58.851 | 71.060 | 1.00 | 0.00 | XXXX | 5170 |
| ATOM | 5171 | CA | VAL B | 305 | 0.865 | 59.937 | 71.045 | 1.00 | 0.00 | XXXX | 5171 |
| ATOM | 5172 | C | VAL B | 305 | −0.119 | 59.795 | 72.202 | 1.00 | 0.00 | XXXX | 5172 |
| ATOM | 5173 | O | VAL B | 305 | −0.412 | 60.763 | 72.907 | 1.00 | 0.00 | XXXX | 5173 |
| ATOM | 5174 | CB | VAL B | 305 | 0.085 | 59.980 | 69.719 | 1.00 | 0.00 | XXXX | 5174 |
| ATOM | 5175 | CG1 | VAL B | 305 | −1.115 | 60.903 | 69.841 | 1.00 | 0.00 | XXXX | 5175 |
| ATOM | 5176 | CG2 | VAL B | 305 | 0.995 | 60.423 | 68.582 | 1.00 | 0.00 | XXXX | 5176 |
| ATOM | 5177 | N | GLU B | 306 | −0.630 | 58.580 | 72.380 | 1.00 | 0.00 | XXXX | 5177 |
| ATOM | 5178 | CA | GLU B | 306 | −1.529 | 58.262 | 73.486 | 1.00 | 0.00 | XXXX | 5178 |
| ATOM | 5179 | C | GLU B | 306 | −0.912 | 58.605 | 74.837 | 1.00 | 0.00 | XXXX | 5179 |
| ATOM | 5180 | O | GLU B | 306 | −1.553 | 59.227 | 75.686 | 1.00 | 0.00 | XXXX | 5180 |
| ATOM | 5181 | CB | GLU B | 306 | −1.906 | 56.779 | 73.444 | 1.00 | 0.00 | XXXX | 5181 |
| ATOM | 5182 | CG | GLU B | 306 | −3.029 | 56.458 | 72.479 | 1.00 | 0.00 | XXXX | 5182 |
| ATOM | 5183 | CD | GLU B | 306 | −4.330 | 57.112 | 72.888 | 1.00 | 0.00 | XXXX | 5183 |
| ATOM | 5184 | OE1 | GLU B | 306 | −4.583 | 57.189 | 74.107 | 1.00 | 0.00 | XXXX | 5184 |
| ATOM | 5185 | OE2 | GLU B | 306 | −5.092 | 57.552 | 72.001 | 1.00 | 0.00 | XXXX | 5185 |

-continued

| | | | | | | | | | | |
|---|---|---|---|---|---|---|---|---|---|---|
| ATOM | 5186 | N | LYS B | 307 | 0.339 | 58.198 | 75.023 | 1.00 | 0.00 | XXXX | 5186 |
| ATOM | 5187 | CA | LYS B | 307 | 1.062 | 58.443 | 76.263 | 1.00 | 0.00 | XXXX | 5187 |
| ATOM | 5188 | C | LYS B | 307 | 1.350 | 59.929 | 76.454 | 1.00 | 0.00 | XXXX | 5188 |
| ATOM | 5189 | O | LYS B | 307 | 1.239 | 60.457 | 77.561 | 1.00 | 0.00 | XXXX | 5189 |
| ATOM | 5190 | CB | LYS B | 307 | 2.365 | 57.640 | 76.274 | 1.00 | 0.00 | XXXX | 5190 |
| ATOM | 5191 | CG | LYS B | 307 | 3.236 | 57.843 | 77.499 | 1.00 | 0.00 | XXXX | 5191 |
| ATOM | 5192 | CD | LYS B | 307 | 4.498 | 57.002 | 77.390 | 1.00 | 0.00 | XXXX | 5192 |
| ATOM | 5193 | CE | LYS B | 307 | 5.546 | 57.413 | 78.407 | 1.00 | 0.00 | XXXX | 5193 |
| ATOM | 5194 | NZ | LYS B | 307 | 6.834 | 56.702 | 78.171 | 1.00 | 0.00 | XXXX | 5194 |
| ATOM | 5195 | N | ALA B | 308 | 1.719 | 60.599 | 75.367 | 1.00 | 0.00 | XXXX | 5195 |
| ATOM | 5196 | CA | ALA B | 308 | 2.017 | 62.026 | 75.407 | 1.00 | 0.00 | XXXX | 5196 |
| ATOM | 5197 | C | ALA B | 308 | 0.754 | 62.860 | 75.589 | 1.00 | 0.00 | XXXX | 5197 |
| ATOM | 5198 | O | ALA B | 308 | 0.809 | 63.983 | 76.092 | 1.00 | 0.00 | XXXX | 5198 |
| ATOM | 5199 | CB | ALA B | 308 | 2.748 | 62.449 | 74.141 | 1.00 | 0.00 | XXXX | 5199 |
| ATOM | 5200 | N | GLY B | 309 | −0.383 | 62.311 | 75.173 | 1.00 | 0.00 | XXXX | 5200 |
| ATOM | 5201 | CA | GLY B | 309 | −1.634 | 63.045 | 75.206 | 1.00 | 0.00 | XXXX | 5201 |
| ATOM | 5202 | C | GLY B | 309 | −1.660 | 64.135 | 74.151 | 1.00 | 0.00 | XXXX | 5202 |
| ATOM | 5203 | O | GLY B | 309 | −2.453 | 65.073 | 74.230 | 1.00 | 0.00 | XXXX | 5203 |
| ATOM | 5204 | N | SER B | 310 | −0.782 | 64.008 | 73.161 | 1.00 | 0.00 | XXXX | 5204 |
| ATOM | 5205 | CA | SER B | 310 | −0.627 | 65.030 | 72.133 | 1.00 | 0.00 | XXXX | 5205 |
| ATOM | 5206 | C | SER B | 310 | 0.140 | 64.489 | 70.932 | 1.00 | 0.00 | XXXX | 5206 |
| ATOM | 5207 | O | SER B | 310 | 0.955 | 63.577 | 71.066 | 1.00 | 0.00 | XXXX | 5207 |
| ATOM | 5208 | CB | SER B | 310 | 0.091 | 66.256 | 72.703 | 1.00 | 0.00 | XXXX | 5208 |
| ATOM | 5209 | OG | SER B | 310 | 0.316 | 67.232 | 71.701 | 1.00 | 0.00 | XXXX | 5209 |
| ATOM | 5210 | N | THR B | 311 | −0.125 | 65.054 | 69.758 | 1.00 | 0.00 | XXXX | 5210 |
| ATOM | 5211 | CA | THR B | 311 | 0.622 | 64.699 | 68.557 | 1.00 | 0.00 | XXXX | 5211 |
| ATOM | 5212 | C | THR B | 311 | 1.834 | 65.607 | 68.383 | 1.00 | 0.00 | XXXX | 5212 |
| ATOM | 5213 | O | THR B | 311 | 2.617 | 65.434 | 67.449 | 1.00 | 0.00 | XXXX | 5213 |
| ATOM | 5214 | CB | THR B | 311 | −0.257 | 64.779 | 67.294 | 1.00 | 0.00 | XXXX | 5214 |
| ATOM | 5215 | OG1 | THR B | 311 | −0.735 | 66.118 | 67.124 | 1.00 | 0.00 | XXXX | 5215 |
| ATOM | 5216 | CG2 | THR B | 311 | −1.440 | 63.830 | 67.406 | 1.00 | 0.00 | XXXX | 5216 |
| ATOM | 5217 | N | ASP B | 312 | 1.974 | 66.582 | 69.278 | 1.00 | 0.00 | XXXX | 5217 |
| ATOM | 5218 | CA | ASP B | 312 | 3.128 | 67.476 | 69.262 | 1.00 | 0.00 | XXXX | 5218 |
| ATOM | 5219 | C | ASP B | 312 | 4.415 | 66.656 | 69.263 | 1.00 | 0.00 | XXXX | 5219 |
| ATOM | 5220 | O | ASP B | 312 | 4.613 | 65.800 | 70.125 | 1.00 | 0.00 | XXXX | 5220 |
| ATOM | 5221 | CB | ASP B | 312 | 3.094 | 68.430 | 70.458 | 1.00 | 0.00 | XXXX | 5221 |
| ATOM | 5222 | CG | ASP B | 312 | 4.312 | 69.330 | 70.518 | 1.00 | 0.00 | XXXX | 5222 |
| ATOM | 5223 | OD1 | ASP B | 312 | 4.347 | 70.336 | 69.776 | 1.00 | 0.00 | XXXX | 5223 |
| ATOM | 5224 | OD2 | ASP B | 312 | 5.236 | 69.033 | 71.305 | 1.00 | 0.00 | XXXX | 5224 |
| ATOM | 5225 | N | VAL B | 313 | 5.281 | 66.924 | 68.291 | 1.00 | 0.00 | XXXX | 5225 |
| ATOM | 5226 | CA | VAL B | 313 | 6.447 | 66.082 | 68.035 | 1.00 | 0.00 | XXXX | 5226 |
| ATOM | 5227 | C | VAL B | 313 | 7.392 | 65.979 | 69.229 | 1.00 | 0.00 | XXXX | 5227 |
| ATOM | 5228 | O | VAL B | 313 | 7.876 | 64.893 | 69.551 | 1.00 | 0.00 | XXXX | 5228 |
| ATOM | 5229 | CB | VAL B | 313 | 7.237 | 66.593 | 66.816 | 1.00 | 0.00 | XXXX | 5229 |
| ATOM | 5230 | CG1 | VAL B | 313 | 8.619 | 65.958 | 66.773 | 1.00 | 0.00 | XXXX | 5230 |
| ATOM | 5231 | CG2 | VAL B | 313 | 6.471 | 66.298 | 65.535 | 1.00 | 0.00 | XXXX | 5231 |
| ATOM | 5232 | N | ASP B | 314 | 7.651 | 67.105 | 69.885 | 1.00 | 0.00 | XXXX | 5232 |
| ATOM | 5233 | CA | ASP B | 314 | 8.546 | 67.116 | 71.037 | 1.00 | 0.00 | XXXX | 5233 |
| ATOM | 5234 | C | ASP B | 314 | 7.981 | 66.282 | 72.183 | 1.00 | 0.00 | XXXX | 5234 |
| ATOM | 5235 | O | ASP B | 314 | 8.725 | 65.599 | 72.885 | 1.00 | 0.00 | XXXX | 5235 |
| ATOM | 5236 | CB | ASP B | 314 | 8.808 | 68.549 | 71.506 | 1.00 | 0.00 | XXXX | 5236 |
| ATOM | 5237 | CG | ASP B | 314 | 9.617 | 69.350 | 70.503 | 1.00 | 0.00 | XXXX | 5237 |
| ATOM | 5238 | OD1 | ASP B | 314 | 10.321 | 68.735 | 69.673 | 1.00 | 0.00 | XXXX | 5238 |
| ATOM | 5239 | OD2 | ASP B | 314 | 9.557 | 70.596 | 70.551 | 1.00 | 0.00 | XXXX | 5239 |
| ATOM | 5240 | N | LYS B | 315 | 6.666 | 66.339 | 72.369 | 1.00 | 0.00 | XXXX | 5240 |
| ATOM | 5241 | CA | LYS B | 315 | 6.015 | 65.547 | 73.404 | 1.00 | 0.00 | XXXX | 5241 |
| ATOM | 5242 | C | LYS B | 315 | 6.016 | 64.073 | 73.016 | 1.00 | 0.00 | XXXX | 5242 |
| ATOM | 5243 | O | LYS B | 315 | 6.233 | 63.198 | 73.853 | 1.00 | 0.00 | XXXX | 5243 |
| ATOM | 5244 | CB | LYS B | 315 | 4.581 | 66.028 | 73.639 | 1.00 | 0.00 | XXXX | 5244 |
| ATOM | 5245 | CG | LYS B | 315 | 4.470 | 67.437 | 74.198 | 1.00 | 0.00 | XXXX | 5245 |
| ATOM | 5246 | CD | LYS B | 315 | 3.013 | 67.871 | 74.287 | 1.00 | 0.00 | XXXX | 5246 |
| ATOM | 5247 | CE | LYS B | 315 | 2.884 | 69.291 | 74.812 | 1.00 | 0.00 | XXXX | 5247 |
| ATOM | 5248 | NZ | LYS B | 315 | 3.465 | 69.431 | 76.174 | 1.00 | 0.00 | XXXX | 5248 |
| ATOM | 5249 | N | VAL B | 316 | 5.771 | 63.809 | 71.737 | 1.00 | 0.00 | XXXX | 5249 |
| ATOM | 5250 | CA | VAL B | 316 | 5.782 | 62.447 | 71.218 | 1.00 | 0.00 | XXXX | 5250 |
| ATOM | 5251 | C | VAL B | 316 | 7.175 | 61.832 | 71.322 | 1.00 | 0.00 | XXXX | 5251 |
| ATOM | 5252 | O | VAL B | 316 | 7.319 | 60.666 | 71.695 | 1.00 | 0.00 | XXXX | 5252 |
| ATOM | 5253 | CB | VAL B | 316 | 5.311 | 62.397 | 69.754 | 1.00 | 0.00 | XXXX | 5253 |
| ATOM | 5254 | CG1 | VAL B | 316 | 5.592 | 61.029 | 69.151 | 1.00 | 0.00 | XXXX | 5254 |
| ATOM | 5255 | CG2 | VAL B | 316 | 3.828 | 62.729 | 69.666 | 1.00 | 0.00 | XXXX | 5255 |
| ATOM | 5256 | N | ARG B | 317 | 8.195 | 62.617 | 70.985 | 1.00 | 0.00 | XXXX | 5256 |
| ATOM | 5257 | CA | ARG B | 317 | 9.577 | 62.153 | 71.061 | 1.00 | 0.00 | XXXX | 5257 |
| ATOM | 5258 | C | ARG B | 317 | 9.944 | 61.731 | 72.481 | 1.00 | 0.00 | XXXX | 5258 |
| ATOM | 5259 | O | ARG B | 317 | 10.583 | 60.699 | 72.685 | 1.00 | 0.00 | XXXX | 5259 |
| ATOM | 5260 | CB | ARG B | 317 | 10.545 | 63.236 | 70.572 | 1.00 | 0.00 | XXXX | 5260 |
| ATOM | 5261 | CG | ARG B | 317 | 11.989 | 62.754 | 70.492 | 1.00 | 0.00 | XXXX | 5261 |
| ATOM | 5262 | CD | ARG B | 317 | 12.966 | 63.857 | 70.107 | 1.00 | 0.00 | XXXX | 5262 |
| ATOM | 5263 | NE | ARG B | 317 | 12.669 | 64.451 | 68.806 | 1.00 | 0.00 | XXXX | 5263 |
| ATOM | 5264 | CZ | ARG B | 317 | 12.055 | 65.617 | 68.639 | 1.00 | 0.00 | XXXX | 5264 |

-continued

| | | | | | | | | | | |
|---|---|---|---|---|---|---|---|---|---|---|
| ATOM | 5265 | NH1 | ARG B | 317 | 11.676 | 66.326 | 69.692 | 1.00 | 0.00 | XXXX | 5265 |
| ATOM | 5266 | NH2 | ARG B | 317 | 11.827 | 66.078 | 67.417 | 1.00 | 0.00 | XXXX | 5266 |
| ATOM | 5267 | N | GLU B | 318 | 9.539 | 62.537 | 73.456 | 1.00 | 0.00 | XXXX | 5267 |
| ATOM | 5268 | CA | GLU B | 318 | 9.828 | 62.255 | 74.858 | 1.00 | 0.00 | XXXX | 5268 |
| ATOM | 5269 | C | GLU B | 318 | 9.098 | 61.006 | 75.341 | 1.00 | 0.00 | XXXX | 5269 |
| ATOM | 5270 | O | GLU B | 318 | 9.681 | 60.154 | 76.011 | 1.00 | 0.00 | XXXX | 5270 |
| ATOM | 5271 | CB | GLU B | 318 | 9.450 | 63.455 | 75.732 | 1.00 | 0.00 | XXXX | 5271 |
| ATOM | 5272 | CG | GLU B | 318 | 9.682 | 63.242 | 77.221 | 1.00 | 0.00 | XXXX | 5272 |
| ATOM | 5273 | CD | GLU B | 318 | 11.127 | 62.913 | 77.547 | 1.00 | 0.00 | XXXX | 5273 |
| ATOM | 5274 | OE1 | GLU B | 318 | 12.025 | 63.390 | 76.823 | 1.00 | 0.00 | XXXX | 5274 |
| ATOM | 5275 | OE2 | GLU B | 318 | 11.364 | 62.175 | 78.527 | 1.00 | 0.00 | XXXX | 5275 |
| ATOM | 5276 | N | ALA B | 319 | 7.817 | 60.905 | 74.997 | 1.00 | 0.00 | XXXX | 5276 |
| ATOM | 5277 | CA | ALA B | 319 | 6.987 | 59.781 | 75.423 | 1.00 | 0.00 | XXXX | 5277 |
| ATOM | 5278 | C | ALA B | 319 | 7.429 | 58.453 | 74.809 | 1.00 | 0.00 | XXXX | 5278 |
| ATOM | 5279 | O | ALA B | 319 | 7.268 | 57.395 | 75.418 | 1.00 | 0.00 | XXXX | 5279 |
| ATOM | 5280 | CB | ALA B | 319 | 5.527 | 60.053 | 75.084 | 1.00 | 0.00 | XXXX | 5280 |
| ATOM | 5281 | N | ALA B | 320 | 7.991 | 58.512 | 73.606 | 1.00 | 0.00 | XXXX | 5281 |
| ATOM | 5282 | CA | ALA B | 320 | 8.351 | 57.304 | 72.868 | 1.00 | 0.00 | XXXX | 5282 |
| ATOM | 5283 | C | ALA B | 320 | 9.490 | 56.530 | 73.528 | 1.00 | 0.00 | XXXX | 5283 |
| ATOM | 5284 | O | ALA B | 320 | 9.622 | 55.322 | 73.328 | 1.00 | 0.00 | XXXX | 5284 |
| ATOM | 5285 | CB | ALA B | 320 | 8.723 | 57.655 | 71.437 | 1.00 | 0.00 | XXXX | 5285 |
| ATOM | 5286 | N | LYS B | 321 | 10.318 | 57.229 | 74.299 | 1.00 | 0.00 | XXXX | 5286 |
| ATOM | 5287 | CA | LYS B | 321 | 11.463 | 56.602 | 74.952 | 1.00 | 0.00 | XXXX | 5287 |
| ATOM | 5288 | C | LYS B | 321 | 11.047 | 55.458 | 75.870 | 1.00 | 0.00 | XXXX | 5288 |
| ATOM | 5289 | O | LYS B | 321 | 10.317 | 55.662 | 76.838 | 1.00 | 0.00 | XXXX | 5289 |
| ATOM | 5290 | CB | LYS B | 321 | 12.259 | 57.634 | 75.753 | 1.00 | 0.00 | XXXX | 5290 |
| ATOM | 5291 | CG | LYS B | 321 | 12.849 | 58.758 | 74.922 | 1.00 | 0.00 | XXXX | 5291 |
| ATOM | 5292 | CD | LYS B | 321 | 13.701 | 59.677 | 75.782 | 1.00 | 0.00 | XXXX | 5292 |
| ATOM | 5293 | CE | LYS B | 321 | 14.254 | 60.834 | 74.971 | 1.00 | 0.00 | XXXX | 5293 |
| ATOM | 5294 | NZ | LYS B | 321 | 14.951 | 60.366 | 73.741 | 1.00 | 0.00 | XXXX | 5294 |
| ATOM | 5295 | N | GLY B | 322 | 11.520 | 54.255 | 75.560 | 1.00 | 0.00 | XXXX | 5295 |
| ATOM | 5296 | CA | GLY B | 322 | 11.273 | 53.101 | 76.404 | 1.00 | 0.00 | XXXX | 5296 |
| ATOM | 5297 | C | GLY B | 322 | 9.960 | 52.378 | 76.169 | 1.00 | 0.00 | XXXX | 5297 |
| ATOM | 5298 | O | GLY B | 322 | 9.685 | 51.372 | 76.823 | 1.00 | 0.00 | XXXX | 5298 |
| ATOM | 5299 | N | ILE B | 323 | 9.144 | 52.876 | 75.245 | 1.00 | 0.00 | XXXX | 5299 |
| ATOM | 5300 | CA | ILE B | 323 | 7.863 | 52.234 | 74.968 | 1.00 | 0.00 | XXXX | 5300 |
| ATOM | 5301 | C | ILE B | 323 | 8.075 | 50.838 | 74.394 | 1.00 | 0.00 | XXXX | 5301 |
| ATOM | 5302 | O | ILE B | 323 | 8.876 | 50.641 | 73.479 | 1.00 | 0.00 | XXXX | 5302 |
| ATOM | 5303 | CB | ILE B | 323 | 7.001 | 53.054 | 73.995 | 1.00 | 0.00 | XXXX | 5303 |
| ATOM | 5304 | CG1 | ILE B | 323 | 6.486 | 54.322 | 74.675 | 1.00 | 0.00 | XXXX | 5304 |
| ATOM | 5305 | CD1 | ILE B | 323 | 5.444 | 55.063 | 73.863 | 1.00 | 0.00 | XXXX | 5305 |
| ATOM | 5306 | CG2 | ILE B | 323 | 5.825 | 52.224 | 73.504 | 1.00 | 0.00 | XXXX | 5306 |
| ATOM | 5307 | N | GLU B | 324 | 7.347 | 49.872 | 74.944 | 1.00 | 0.00 | XXXX | 5307 |
| ATOM | 5308 | CA | GLU B | 324 | 7.476 | 48.483 | 74.533 | 1.00 | 0.00 | XXXX | 5308 |
| ATOM | 5309 | C | GLU B | 324 | 6.342 | 48.087 | 73.599 | 1.00 | 0.00 | XXXX | 5309 |
| ATOM | 5310 | O | GLU B | 324 | 5.323 | 48.772 | 73.516 | 1.00 | 0.00 | XXXX | 5310 |
| ATOM | 5311 | CB | GLU B | 324 | 7.493 | 47.566 | 75.756 | 1.00 | 0.00 | XXXX | 5311 |
| ATOM | 5312 | CG | GLU B | 324 | 8.595 | 47.882 | 76.752 | 1.00 | 0.00 | XXXX | 5312 |
| ATOM | 5313 | CD | GLU B | 324 | 8.403 | 47.169 | 78.074 | 1.00 | 0.00 | XXXX | 5313 |
| ATOM | 5314 | OE1 | GLU B | 324 | 7.240 | 46.893 | 78.435 | 1.00 | 0.00 | XXXX | 5314 |
| ATOM | 5315 | OE2 | GLU B | 324 | 9.412 | 46.886 | 78.753 | 1.00 | 0.00 | XXXX | 5315 |
| ATOM | 5316 | N | PHE B | 325 | 6.530 | 46.981 | 72.891 | 1.00 | 0.00 | XXXX | 5316 |
| ATOM | 5317 | CA | PHE B | 325 | 5.480 | 46.431 | 72.049 | 1.00 | 0.00 | XXXX | 5317 |
| ATOM | 5318 | C | PHE B | 325 | 5.695 | 44.936 | 71.869 | 1.00 | 0.00 | XXXX | 5318 |
| ATOM | 5319 | O | PHE B | 325 | 6.798 | 44.494 | 71.546 | 1.00 | 0.00 | XXXX | 5319 |
| ATOM | 5320 | CB | PHE B | 325 | 5.449 | 47.137 | 70.690 | 1.00 | 0.00 | XXXX | 5320 |
| ATOM | 5321 | CG | PHE B | 325 | 4.246 | 46.796 | 69.855 | 1.00 | 0.00 | XXXX | 5321 |
| ATOM | 5322 | CD1 | PHE B | 325 | 2.999 | 47.310 | 70.171 | 1.00 | 0.00 | XXXX | 5322 |
| ATOM | 5323 | CD2 | PHE B | 325 | 4.361 | 45.964 | 68.753 | 1.00 | 0.00 | XXXX | 5323 |
| ATOM | 5324 | CE1 | PHE B | 325 | 1.888 | 47.000 | 69.404 | 1.00 | 0.00 | XXXX | 5324 |
| ATOM | 5325 | CE2 | PHE B | 325 | 3.255 | 45.651 | 67.982 | 1.00 | 0.00 | XXXX | 5325 |
| ATOM | 5326 | CZ | PHE B | 325 | 2.018 | 46.169 | 68.309 | 1.00 | 0.00 | XXXX | 5326 |
| ATOM | 5327 | N | ASN B | 326 | 4.641 | 44.158 | 72.081 | 1.00 | 0.00 | XXXX | 5327 |
| ATOM | 5328 | CA | ASN B | 326 | 4.706 | 42.726 | 71.830 | 1.00 | 0.00 | XXXX | 5328 |
| ATOM | 5329 | C | ASN B | 326 | 4.562 | 42.432 | 70.340 | 1.00 | 0.00 | XXXX | 5329 |
| ATOM | 5330 | O | ASN B | 326 | 3.502 | 42.030 | 69.866 | 1.00 | 0.00 | XXXX | 5330 |
| ATOM | 5331 | CB | ASN B | 326 | 3.640 | 41.992 | 72.649 | 1.00 | 0.00 | XXXX | 5331 |
| ATOM | 5332 | CG | ASN B | 326 | 2.278 | 42.651 | 72.563 | 1.00 | 0.00 | XXXX | 5332 |
| ATOM | 5333 | OD1 | ASN B | 326 | 2.168 | 43.877 | 72.548 | 1.00 | 0.00 | XXXX | 5333 |
| ATOM | 5334 | ND2 | ASN B | 326 | 1.229 | 41.837 | 72.504 | 1.00 | 0.00 | XXXX | 5334 |
| ATOM | 5335 | N | ALA B | 327 | 5.654 | 42.629 | 69.609 | 1.00 | 0.00 | XXXX | 5335 |
| ATOM | 5336 | CA | ALA B | 327 | 5.659 | 42.470 | 68.160 | 1.00 | 0.00 | XXXX | 5336 |
| ATOM | 5337 | C | ALA B | 327 | 5.620 | 40.999 | 67.761 | 1.00 | 0.00 | XXXX | 5337 |
| ATOM | 5338 | O | ALA B | 327 | 5.946 | 40.125 | 68.562 | 1.00 | 0.00 | XXXX | 5338 |
| ATOM | 5339 | CB | ALA B | 327 | 6.882 | 43.150 | 67.560 | 1.00 | 0.00 | XXXX | 5339 |
| ATOM | 5340 | N | PRO B | 328 | 5.204 | 40.725 | 66.517 | 1.00 | 0.00 | XXXX | 5340 |
| ATOM | 5341 | CA | PRO B | 328 | 5.196 | 39.375 | 65.943 | 1.00 | 0.00 | XXXX | 5341 |
| ATOM | 5342 | C | PRO B | 328 | 6.546 | 38.668 | 66.058 | 1.00 | 0.00 | XXXX | 5342 |
| ATOM | 5343 | O | PRO B | 328 | 6.590 | 37.457 | 66.268 | 1.00 | 0.00 | XXXX | 5343 |

-continued

| | | | | | | | | | | |
|---|---|---|---|---|---|---|---|---|---|---|
| ATOM | 5344 | CB | PRO B | 328 | 4.839 | 39.628 | 64.477 | 1.00 | 0.00 | XXXX | 5344 |
| ATOM | 5345 | CG | PRO B | 328 | 4.008 | 40.863 | 64.517 | 1.00 | 0.00 | XXXX | 5345 |
| ATOM | 5346 | CD | PRO B | 328 | 4.633 | 41.718 | 65.589 | 1.00 | 0.00 | XXXX | 5346 |
| ATOM | 5347 | N | GLU B | 329 | 7.633 | 39.424 | 65.930 | 1.00 | 0.00 | XXXX | 5347 |
| ATOM | 5348 | CA | GLU B | 329 | 8.973 | 38.845 | 65.961 | 1.00 | 0.00 | XXXX | 5348 |
| ATOM | 5349 | C | GLU B | 329 | 9.391 | 38.505 | 67.385 | 1.00 | 0.00 | XXXX | 5349 |
| ATOM | 5350 | O | GLU B | 329 | 10.335 | 37.747 | 67.605 | 1.00 | 0.00 | XXXX | 5350 |
| ATOM | 5351 | CB | GLU B | 329 | 9.992 | 39.805 | 65.347 | 1.00 | 0.00 | XXXX | 5351 |
| ATOM | 5352 | CG | GLU B | 329 | 10.286 | 41.019 | 66.217 | 1.00 | 0.00 | XXXX | 5352 |
| ATOM | 5353 | CD | GLU B | 329 | 11.470 | 41.829 | 65.720 | 1.00 | 0.00 | XXXX | 5353 |
| ATOM | 5354 | OE1 | GLU B | 329 | 11.365 | 42.435 | 64.634 | 1.00 | 0.00 | XXXX | 5354 |
| ATOM | 5355 | OE2 | GLU B | 329 | 12.503 | 41.863 | 66.422 | 1.00 | 0.00 | XXXX | 5355 |
| ATOM | 5356 | N | GLY B | 330 | 8.679 | 39.073 | 68.349 | 1.00 | 0.00 | XXXX | 5356 |
| ATOM | 5357 | CA | GLY B | 330 | 9.061 | 38.973 | 69.744 | 1.00 | 0.00 | XXXX | 5357 |
| ATOM | 5358 | C | GLY B | 330 | 8.975 | 40.348 | 70.370 | 1.00 | 0.00 | XXXX | 5358 |
| ATOM | 5359 | O | GLY B | 330 | 8.512 | 41.291 | 69.727 | 1.00 | 0.00 | XXXX | 5359 |
| ATOM | 5360 | N | PRO B | 331 | 9.414 | 40.476 | 71.629 | 1.00 | 0.00 | XXXX | 5360 |
| ATOM | 5361 | CA | PRO B | 331 | 9.332 | 41.777 | 72.296 | 1.00 | 0.00 | XXXX | 5361 |
| ATOM | 5362 | C | PRO B | 331 | 10.270 | 42.796 | 71.658 | 1.00 | 0.00 | XXXX | 5362 |
| ATOM | 5363 | O | PRO B | 331 | 11.432 | 42.489 | 71.397 | 1.00 | 0.00 | XXXX | 5363 |
| ATOM | 5364 | CB | PRO B | 331 | 9.754 | 41.464 | 73.735 | 1.00 | 0.00 | XXXX | 5364 |
| ATOM | 5365 | CG | PRO B | 331 | 10.588 | 40.236 | 73.626 | 1.00 | 0.00 | XXXX | 5365 |
| ATOM | 5366 | CD | PRO B | 331 | 10.008 | 39.442 | 72.493 | 1.00 | 0.00 | XXXX | 5366 |
| ATOM | 5367 | N | VAL B | 332 | 9.758 | 43.995 | 71.408 | 1.00 | 0.00 | XXXX | 5367 |
| ATOM | 5368 | CA | VAL B | 332 | 10.586 | 45.090 | 70.926 | 1.00 | 0.00 | XXXX | 5368 |
| ATOM | 5369 | C | VAL B | 332 | 10.400 | 46.306 | 71.818 | 1.00 | 0.00 | XXXX | 5369 |
| ATOM | 5370 | O | VAL B | 332 | 9.480 | 46.359 | 72.633 | 1.00 | 0.00 | XXXX | 5370 |
| ATOM | 5371 | CB | VAL B | 332 | 10.260 | 45.468 | 69.465 | 1.00 | 0.00 | XXXX | 5371 |
| ATOM | 5372 | CG1 | VAL B | 332 | 10.520 | 44.290 | 68.541 | 1.00 | 0.00 | XXXX | 5372 |
| ATOM | 5373 | CG2 | VAL B | 332 | 8.820 | 45.952 | 69.343 | 1.00 | 0.00 | XXXX | 5373 |
| ATOM | 5374 | N | LYS B | 333 | 11.283 | 47.282 | 71.658 | 1.00 | 0.00 | XXXX | 5374 |
| ATOM | 5375 | CA | LYS B | 333 | 11.265 | 48.468 | 72.497 | 1.00 | 0.00 | XXXX | 5375 |
| ATOM | 5376 | C | LYS B | 333 | 12.003 | 49.612 | 71.824 | 1.00 | 0.00 | XXXX | 5376 |
| ATOM | 5377 | O | LYS B | 333 | 13.043 | 49.405 | 71.202 | 1.00 | 0.00 | XXXX | 5377 |
| ATOM | 5378 | CB | LYS B | 333 | 11.890 | 48.151 | 73.858 | 1.00 | 0.00 | XXXX | 5378 |
| ATOM | 5379 | CG | LYS B | 333 | 12.158 | 49.357 | 74.735 | 1.00 | 0.00 | XXXX | 5379 |
| ATOM | 5380 | CD | LYS B | 333 | 13.097 | 48.984 | 75.872 | 1.00 | 0.00 | XXXX | 5380 |
| ATOM | 5381 | CE | LYS B | 333 | 13.652 | 50.216 | 76.561 | 1.00 | 0.00 | XXXX | 5381 |
| ATOM | 5382 | NZ | LYS B | 333 | 14.533 | 51.020 | 75.671 | 1.00 | 0.00 | XXXX | 5382 |
| ATOM | 5383 | N | ILE B | 334 | 11.464 | 50.820 | 71.947 | 1.00 | 0.00 | XXXX | 5383 |
| ATOM | 5384 | CA | ILE B | 334 | 12.143 | 51.992 | 71.417 | 1.00 | 0.00 | XXXX | 5384 |
| ATOM | 5385 | C | ILE B | 334 | 13.299 | 52.378 | 72.331 | 1.00 | 0.00 | XXXX | 5385 |
| ATOM | 5386 | O | ILE B | 334 | 13.099 | 52.725 | 73.496 | 1.00 | 0.00 | XXXX | 5386 |
| ATOM | 5387 | CB | ILE B | 334 | 11.185 | 53.185 | 71.254 | 1.00 | 0.00 | XXXX | 5387 |
| ATOM | 5388 | CG1 | ILE B | 334 | 10.079 | 52.839 | 70.255 | 1.00 | 0.00 | XXXX | 5388 |
| ATOM | 5389 | CG2 | ILE B | 334 | 11.945 | 54.415 | 70.793 | 1.00 | 0.00 | XXXX | 5389 |
| ATOM | 5390 | CD1 | ILE B | 334 | 9.150 | 53.990 | 69.938 | 1.00 | 0.00 | XXXX | 5390 |
| ATOM | 5391 | N | ASP B | 335 | 14.510 | 52.316 | 71.788 | 1.00 | 0.00 | XXXX | 5391 |
| ATOM | 5392 | CA | ASP B | 335 | 15.706 | 52.701 | 72.520 | 1.00 | 0.00 | XXXX | 5392 |
| ATOM | 5393 | C | ASP B | 335 | 15.749 | 54.218 | 72.669 | 1.00 | 0.00 | XXXX | 5393 |
| ATOM | 5394 | O | ASP B | 335 | 15.941 | 54.940 | 71.691 | 1.00 | 0.00 | XXXX | 5394 |
| ATOM | 5395 | CB | ASP B | 335 | 16.959 | 52.185 | 71.803 | 1.00 | 0.00 | XXXX | 5395 |
| ATOM | 5396 | CG | ASP B | 335 | 18.228 | 52.362 | 72.623 | 1.00 | 0.00 | XXXX | 5396 |
| ATOM | 5397 | OD1 | ASP B | 335 | 18.221 | 53.145 | 73.596 | 1.00 | 0.00 | XXXX | 5397 |
| ATOM | 5398 | OD2 | ASP B | 335 | 19.238 | 51.706 | 72.291 | 1.00 | 0.00 | XXXX | 5398 |
| ATOM | 5399 | N | GLY B | 336 | 15.559 | 54.693 | 73.897 | 1.00 | 0.00 | XXXX | 5399 |
| ATOM | 5400 | CA | GLY B | 336 | 15.595 | 56.116 | 74.185 | 1.00 | 0.00 | XXXX | 5400 |
| ATOM | 5401 | C | GLY B | 336 | 16.897 | 56.781 | 73.777 | 1.00 | 0.00 | XXXX | 5401 |
| ATOM | 5402 | O | GLY B | 336 | 16.933 | 57.984 | 73.519 | 1.00 | 0.00 | XXXX | 5402 |
| ATOM | 5403 | N | ASP B | 337 | 17.970 | 55.999 | 73.724 | 1.00 | 0.00 | XXXX | 5403 |
| ATOM | 5404 | CA | ASP B | 337 | 19.285 | 56.520 | 73.363 | 1.00 | 0.00 | XXXX | 5404 |
| ATOM | 5405 | C | ASP B | 337 | 19.370 | 57.006 | 71.917 | 1.00 | 0.00 | XXXX | 5405 |
| ATOM | 5406 | O | ASP B | 337 | 20.122 | 57.932 | 71.612 | 1.00 | 0.00 | XXXX | 5406 |
| ATOM | 5407 | CB | ASP B | 337 | 20.360 | 55.455 | 73.597 | 1.00 | 0.00 | XXXX | 5407 |
| ATOM | 5408 | CG | ASP B | 337 | 20.677 | 55.256 | 75.065 | 1.00 | 0.00 | XXXX | 5408 |
| ATOM | 5409 | OD1 | ASP B | 337 | 20.259 | 56.098 | 75.887 | 1.00 | 0.00 | XXXX | 5409 |
| ATOM | 5410 | OD2 | ASP B | 337 | 21.350 | 54.257 | 75.395 | 1.00 | 0.00 | XXXX | 5410 |
| ATOM | 5411 | N | ASN B | 338 | 18.599 | 56.392 | 71.025 | 1.00 | 0.00 | XXXX | 5411 |
| ATOM | 5412 | CA | ASN B | 338 | 18.787 | 56.640 | 69.600 | 1.00 | 0.00 | XXXX | 5412 |
| ATOM | 5413 | C | ASN B | 338 | 17.537 | 56.467 | 68.742 | 1.00 | 0.00 | XXXX | 5413 |
| ATOM | 5414 | O | ASN B | 338 | 17.603 | 56.574 | 67.517 | 1.00 | 0.00 | XXXX | 5414 |
| ATOM | 5415 | CB | ASN B | 338 | 19.890 | 55.720 | 69.074 | 1.00 | 0.00 | XXXX | 5415 |
| ATOM | 5416 | CG | ASN B | 338 | 19.653 | 54.265 | 69.433 | 1.00 | 0.00 | XXXX | 5416 |
| ATOM | 5417 | OD1 | ASN B | 338 | 18.513 | 53.800 | 69.470 | 1.00 | 0.00 | XXXX | 5417 |
| ATOM | 5418 | ND2 | ASN B | 338 | 20.729 | 53.542 | 69.708 | 1.00 | 0.00 | XXXX | 5418 |
| ATOM | 5419 | N | GLN B | 339 | 16.406 | 56.198 | 69.386 | 1.00 | 0.00 | XXXX | 5419 |
| ATOM | 5420 | CA | GLN B | 339 | 15.128 | 56.094 | 68.689 | 1.00 | 0.00 | XXXX | 5420 |
| ATOM | 5421 | C | GLN B | 339 | 15.096 | 54.936 | 67.684 | 1.00 | 0.00 | XXXX | 5421 |
| ATOM | 5422 | O | GLN B | 339 | 14.257 | 54.903 | 66.782 | 1.00 | 0.00 | XXXX | 5422 |

-continued

| | | | | | | | | | | |
|---|---|---|---|---|---|---|---|---|---|---|
| ATOM | 5423 | CB | GLN B | 339 | 14.808 | 57.425 | 68.000 | 1.00 | 0.00 | XXXX | 5423 |
| ATOM | 5424 | CG | GLN B | 339 | 14.834 | 58.603 | 68.971 | 1.00 | 0.00 | XXXX | 5424 |
| ATOM | 5425 | CD | GLN B | 339 | 14.282 | 59.887 | 68.384 | 1.00 | 0.00 | XXXX | 5425 |
| ATOM | 5426 | OE1 | GLN B | 339 | 14.042 | 60.856 | 69.105 | 1.00 | 0.00 | XXXX | 5426 |
| ATOM | 5427 | NE2 | GLN B | 339 | 14.080 | 59.905 | 67.072 | 1.00 | 0.00 | XXXX | 5427 |
| ATOM | 5428 | N | HIS B | 340 | 16.022 | 53.993 | 67.845 | 1.00 | 0.00 | XXXX | 5428 |
| ATOM | 5429 | CA | HIS B | 340 | 15.967 | 52.713 | 67.142 | 1.00 | 0.00 | XXXX | 5429 |
| ATOM | 5430 | C | HIS B | 340 | 15.188 | 51.696 | 67.979 | 1.00 | 0.00 | XXXX | 5430 |
| ATOM | 5431 | O | HIS B | 340 | 14.705 | 52.021 | 69.063 | 1.00 | 0.00 | XXXX | 5431 |
| ATOM | 5432 | CB | HIS B | 340 | 17.375 | 52.182 | 66.844 | 1.00 | 0.00 | XXXX | 5432 |
| ATOM | 5433 | CG | HIS B | 340 | 18.114 | 52.959 | 65.796 | 1.00 | 0.00 | XXXX | 5433 |
| ATOM | 5434 | ND1 | HIS B | 340 | 18.396 | 54.301 | 65.920 | 1.00 | 0.00 | XXXX | 5434 |
| ATOM | 5435 | CD2 | HIS B | 340 | 18.638 | 52.570 | 64.610 | 1.00 | 0.00 | XXXX | 5435 |
| ATOM | 5436 | CE1 | HIS B | 340 | 19.060 | 54.708 | 64.851 | 1.00 | 0.00 | XXXX | 5436 |
| ATOM | 5437 | NE2 | HIS B | 340 | 19.219 | 53.680 | 64.041 | 1.00 | 0.00 | XXXX | 5437 |
| ATOM | 5438 | N | LEU B | 341 | 15.072 | 50.469 | 67.478 | 1.00 | 0.00 | XXXX | 5438 |
| ATOM | 5439 | CA | LEU B | 341 | 14.372 | 49.403 | 68.197 | 1.00 | 0.00 | XXXX | 5439 |
| ATOM | 5440 | C | LEU B | 341 | 15.306 | 48.319 | 68.727 | 1.00 | 0.00 | XXXX | 5440 |
| ATOM | 5441 | O | LEU B | 341 | 16.285 | 47.956 | 68.072 | 1.00 | 0.00 | XXXX | 5441 |
| ATOM | 5442 | CB | LEU B | 341 | 13.326 | 48.740 | 67.294 | 1.00 | 0.00 | XXXX | 5442 |
| ATOM | 5443 | CG | LEU B | 341 | 11.979 | 49.408 | 67.031 | 1.00 | 0.00 | XXXX | 5443 |
| ATOM | 5444 | CD1 | LEU B | 341 | 11.133 | 48.510 | 66.140 | 1.00 | 0.00 | XXXX | 5444 |
| ATOM | 5445 | CD2 | LEU B | 341 | 11.254 | 49.706 | 68.335 | 1.00 | 0.00 | XXXX | 5445 |
| ATOM | 5446 | N | TYR B | 342 | 14.997 | 47.804 | 69.914 | 1.00 | 0.00 | XXXX | 5446 |
| ATOM | 5447 | CA | TYR B | 342 | 15.530 | 46.515 | 70.337 | 1.00 | 0.00 | XXXX | 5447 |
| ATOM | 5448 | C | TYR B | 342 | 14.916 | 45.436 | 69.455 | 1.00 | 0.00 | XXXX | 5448 |
| ATOM | 5449 | O | TYR B | 342 | 13.693 | 45.305 | 69.400 | 1.00 | 0.00 | XXXX | 5449 |
| ATOM | 5450 | CB | TYR B | 342 | 15.215 | 46.227 | 71.808 | 1.00 | 0.00 | XXXX | 5450 |
| ATOM | 5451 | CG | TYR B | 342 | 16.087 | 46.946 | 72.813 | 1.00 | 0.00 | XXXX | 5451 |
| ATOM | 5452 | CD1 | TYR B | 342 | 16.022 | 48.325 | 72.965 | 1.00 | 0.00 | XXXX | 5452 |
| ATOM | 5453 | CD2 | TYR B | 342 | 16.962 | 46.238 | 73.628 | 1.00 | 0.00 | XXXX | 5453 |
| ATOM | 5454 | CE1 | TYR B | 342 | 16.815 | 48.980 | 73.893 | 1.00 | 0.00 | XXXX | 5454 |
| ATOM | 5455 | CE2 | TYR B | 342 | 17.755 | 46.881 | 74.558 | 1.00 | 0.00 | XXXX | 5455 |
| ATOM | 5456 | CZ | TYR B | 342 | 17.679 | 48.252 | 74.686 | 1.00 | 0.00 | XXXX | 5456 |
| ATOM | 5457 | OH | TYR B | 342 | 18.470 | 48.896 | 75.611 | 1.00 | 0.00 | XXXX | 5457 |
| ATOM | 5458 | N | LYS B | 343 | 15.750 | 44.663 | 68.768 | 1.00 | 0.00 | XXXX | 5458 |
| ATOM | 5459 | CA | LYS B | 343 | 15.235 | 43.618 | 67.890 | 1.00 | 0.00 | XXXX | 5459 |
| ATOM | 5460 | C | LYS B | 343 | 16.035 | 42.323 | 68.012 | 1.00 | 0.00 | XXXX | 5460 |
| ATOM | 5461 | O | LYS B | 343 | 17.238 | 42.339 | 68.280 | 1.00 | 0.00 | XXXX | 5461 |
| ATOM | 5462 | CB | LYS B | 343 | 15.232 | 44.098 | 66.434 | 1.00 | 0.00 | XXXX | 5462 |
| ATOM | 5463 | CG | LYS B | 343 | 14.625 | 45.484 | 66.236 | 1.00 | 0.00 | XXXX | 5463 |
| ATOM | 5464 | CD | LYS B | 343 | 14.397 | 45.797 | 64.763 | 1.00 | 0.00 | XXXX | 5464 |
| ATOM | 5465 | CE | LYS B | 343 | 13.212 | 45.022 | 64.208 | 1.00 | 0.00 | XXXX | 5465 |
| ATOM | 5466 | NZ | LYS B | 343 | 13.006 | 45.288 | 62.758 | 1.00 | 0.00 | XXXX | 5466 |
| ATOM | 5467 | N | THR B | 344 | 15.351 | 41.202 | 67.813 | 1.00 | 0.00 | XXXX | 5467 |
| ATOM | 5468 | CA | THR B | 344 | 16.000 | 39.901 | 67.773 | 1.00 | 0.00 | XXXX | 5468 |
| ATOM | 5469 | C | THR B | 344 | 16.680 | 39.717 | 66.424 | 1.00 | 0.00 | XXXX | 5469 |
| ATOM | 5470 | O | THR B | 344 | 16.161 | 40.158 | 65.401 | 1.00 | 0.00 | XXXX | 5470 |
| ATOM | 5471 | CB | THR B | 344 | 14.992 | 38.762 | 68.002 | 1.00 | 0.00 | XXXX | 5471 |
| ATOM | 5472 | OG1 | THR B | 344 | 14.382 | 38.912 | 69.290 | 1.00 | 0.00 | XXXX | 5472 |
| ATOM | 5473 | CG2 | THR B | 344 | 15.683 | 37.408 | 67.915 | 1.00 | 0.00 | XXXX | 5473 |
| ATOM | 5474 | N | VAL B | 345 | 17.839 | 39.070 | 66.419 | 1.00 | 0.00 | XXXX | 5474 |
| ATOM | 5475 | CA | VAL B | 345 | 18.536 | 38.796 | 65.169 | 1.00 | 0.00 | XXXX | 5475 |
| ATOM | 5476 | C | VAL B | 345 | 18.310 | 37.360 | 64.720 | 1.00 | 0.00 | XXXX | 5476 |
| ATOM | 5477 | O | VAL B | 345 | 18.418 | 36.427 | 65.513 | 1.00 | 0.00 | XXXX | 5477 |
| ATOM | 5478 | CB | VAL B | 345 | 20.046 | 39.052 | 65.292 | 1.00 | 0.00 | XXXX | 5478 |
| ATOM | 5479 | CG1 | VAL B | 345 | 20.734 | 38.801 | 63.958 | 1.00 | 0.00 | XXXX | 5479 |
| ATOM | 5480 | CG2 | VAL B | 345 | 20.302 | 40.471 | 65.772 | 1.00 | 0.00 | XXXX | 5480 |
| ATOM | 5481 | N | ARG B | 346 | 17.994 | 37.197 | 63.441 | 1.00 | 0.00 | XXXX | 5481 |
| ATOM | 5482 | CA | ARG B | 346 | 17.754 | 35.885 | 62.854 | 1.00 | 0.00 | XXXX | 5482 |
| ATOM | 5483 | C | ARG B | 346 | 18.415 | 35.679 | 61.502 | 1.00 | 0.00 | XXXX | 5483 |
| ATOM | 5484 | O | ARG B | 346 | 18.407 | 36.562 | 60.646 | 1.00 | 0.00 | XXXX | 5484 |
| ATOM | 5485 | CB | ARG B | 346 | 16.252 | 35.618 | 62.715 | 1.00 | 0.00 | XXXX | 5485 |
| ATOM | 5486 | CG | ARG B | 346 | 15.426 | 35.874 | 63.958 | 1.00 | 0.00 | XXXX | 5486 |
| ATOM | 5487 | CD | ARG B | 346 | 13.969 | 35.529 | 63.684 | 1.00 | 0.00 | XXXX | 5487 |
| ATOM | 5488 | NE | ARG B | 346 | 13.293 | 35.039 | 64.884 | 1.00 | 0.00 | XXXX | 5488 |
| ATOM | 5489 | CZ | ARG B | 346 | 12.623 | 35.775 | 65.761 | 1.00 | 0.00 | XXXX | 5489 |
| ATOM | 5490 | NH1 | ARG B | 346 | 12.507 | 37.086 | 65.604 | 1.00 | 0.00 | XXXX | 5490 |
| ATOM | 5491 | NH2 | ARG B | 346 | 12.062 | 35.183 | 66.807 | 1.00 | 0.00 | XXXX | 5491 |
| ATOM | 5492 | N | ILE B | 347 | 18.986 | 34.492 | 61.327 | 1.00 | 0.00 | XXXX | 5492 |
| ATOM | 5493 | CA | ILE B | 347 | 19.544 | 34.082 | 60.050 | 1.00 | 0.00 | XXXX | 5493 |
| ATOM | 5494 | C | ILE B | 347 | 18.815 | 32.832 | 59.569 | 1.00 | 0.00 | XXXX | 5494 |
| ATOM | 5495 | O | ILE B | 347 | 18.560 | 31.914 | 60.350 | 1.00 | 0.00 | XXXX | 5495 |
| ATOM | 5496 | CB | ILE B | 347 | 21.054 | 33.801 | 60.155 | 1.00 | 0.00 | XXXX | 5496 |
| ATOM | 5497 | CG1 | ILE B | 347 | 21.802 | 35.063 | 60.595 | 1.00 | 0.00 | XXXX | 5497 |
| ATOM | 5498 | CG2 | ILE B | 347 | 21.591 | 33.270 | 58.834 | 1.00 | 0.00 | XXXX | 5498 |
| ATOM | 5499 | CD1 | ILE B | 347 | 23.288 | 34.853 | 60.812 | 1.00 | 0.00 | XXXX | 5499 |
| ATOM | 5500 | N | GLY B | 348 | 18.471 | 32.796 | 58.287 | 1.00 | 0.00 | XXXX | 5500 |
| ATOM | 5501 | CA | GLY B | 348 | 17.712 | 31.681 | 57.754 | 1.00 | 0.00 | XXXX | 5501 |

-continued

| | | | | | | | | | | |
|---|---|---|---|---|---|---|---|---|---|---|
| ATOM | 5502 | C | GLY B | 348 | 18.022 | 31.370 | 56.306 | 1.00 | 0.00 | XXXX | 5502 |
| ATOM | 5503 | O | GLY B | 348 | 18.645 | 32.169 | 55.606 | 1.00 | 0.00 | XXXX | 5503 |
| ATOM | 5504 | N | GLU B | 349 | 17.580 | 30.201 | 55.853 | 1.00 | 0.00 | XXXX | 5504 |
| ATOM | 5505 | CA | GLU B | 349 | 17.726 | 29.826 | 54.455 | 1.00 | 0.00 | XXXX | 5505 |
| ATOM | 5506 | C | GLU B | 349 | 16.364 | 29.780 | 53.773 | 1.00 | 0.00 | XXXX | 5506 |
| ATOM | 5507 | O | GLU B | 349 | 15.357 | 29.429 | 54.388 | 1.00 | 0.00 | XXXX | 5507 |
| ATOM | 5508 | CB | GLU B | 349 | 18.441 | 28.479 | 54.324 | 1.00 | 0.00 | XXXX | 5508 |
| ATOM | 5509 | CG | GLU B | 349 | 17.690 | 27.298 | 54.907 | 1.00 | 0.00 | XXXX | 5509 |
| ATOM | 5510 | CD | GLU B | 349 | 18.375 | 25.978 | 54.608 | 1.00 | 0.00 | XXXX | 5510 |
| ATOM | 5511 | OE1 | GLU B | 349 | 19.012 | 25.867 | 53.538 | 1.00 | 0.00 | XXXX | 5511 |
| ATOM | 5512 | OE2 | GLU B | 349 | 18.280 | 25.053 | 55.442 | 1.00 | 0.00 | XXXX | 5512 |
| ATOM | 5513 | N | ILE B | 350 | 16.347 | 30.132 | 52.493 | 1.00 | 0.00 | XXXX | 5513 |
| ATOM | 5514 | CA | ILE B | 350 | 15.107 | 30.219 | 51.733 | 1.00 | 0.00 | XXXX | 5514 |
| ATOM | 5515 | C | ILE B | 350 | 14.618 | 28.843 | 51.294 | 1.00 | 0.00 | XXXX | 5515 |
| ATOM | 5516 | O | ILE B | 350 | 15.379 | 28.048 | 50.742 | 1.00 | 0.00 | XXXX | 5516 |
| ATOM | 5517 | CB | ILE B | 350 | 15.283 | 31.119 | 50.497 | 1.00 | 0.00 | XXXX | 5517 |
| ATOM | 5518 | CG1 | ILE B | 350 | 15.787 | 32.499 | 50.925 | 1.00 | 0.00 | XXXX | 5518 |
| ATOM | 5519 | CG2 | ILE B | 350 | 13.977 | 31.224 | 49.717 | 1.00 | 0.00 | XXXX | 5519 |
| ATOM | 5520 | CD1 | ILE B | 350 | 16.269 | 33.361 | 49.779 | 1.00 | 0.00 | XXXX | 5520 |
| ATOM | 5521 | N | LEU B | 351 | 13.341 | 28.572 | 51.546 | 1.00 | 0.00 | XXXX | 5521 |
| ATOM | 5522 | CA | LEU B | 351 | 12.749 | 27.280 | 51.221 | 1.00 | 0.00 | XXXX | 5522 |
| ATOM | 5523 | C | LEU B | 351 | 12.140 | 27.281 | 49.824 | 1.00 | 0.00 | XXXX | 5523 |
| ATOM | 5524 | O | LEU B | 351 | 12.011 | 28.328 | 49.189 | 1.00 | 0.00 | XXXX | 5524 |
| ATOM | 5525 | CB | LEU B | 351 | 11.684 | 26.904 | 52.254 | 1.00 | 0.00 | XXXX | 5525 |
| ATOM | 5526 | CG | LEU B | 351 | 12.156 | 26.760 | 53.702 | 1.00 | 0.00 | XXXX | 5526 |
| ATOM | 5527 | CD1 | LEU B | 351 | 10.974 | 26.540 | 54.638 | 1.00 | 0.00 | XXXX | 5527 |
| ATOM | 5528 | CD2 | LEU B | 351 | 13.167 | 25.625 | 53.827 | 1.00 | 0.00 | XXXX | 5528 |
| ATOM | 5529 | N | GLU B | 352 | 11.769 | 26.094 | 49.355 | 1.00 | 0.00 | XXXX | 5529 |
| ATOM | 5530 | CA | GLU B | 352 | 11.230 | 25.916 | 48.013 | 1.00 | 0.00 | XXXX | 5530 |
| ATOM | 5531 | C | GLU B | 352 | 9.979 | 26.761 | 47.783 | 1.00 | 0.00 | XXXX | 5531 |
| ATOM | 5532 | O | GLU B | 352 | 9.725 | 27.215 | 46.667 | 1.00 | 0.00 | XXXX | 5532 |
| ATOM | 5533 | CB | GLU B | 352 | 10.916 | 24.441 | 47.765 | 1.00 | 0.00 | XXXX | 5533 |
| ATOM | 5534 | CG | GLU B | 352 | 10.379 | 24.136 | 46.378 | 1.00 | 0.00 | XXXX | 5534 |
| ATOM | 5535 | CD | GLU B | 352 | 9.928 | 22.696 | 46.238 | 1.00 | 0.00 | XXXX | 5535 |
| ATOM | 5536 | OE1 | GLU B | 352 | 9.160 | 22.228 | 47.103 | 1.00 | 0.00 | XXXX | 5536 |
| ATOM | 5537 | OE2 | GLU B | 352 | 10.348 | 22.031 | 45.267 | 1.00 | 0.00 | XXXX | 5537 |
| ATOM | 5538 | N | ASN B | 353 | 9.204 | 26.977 | 48.842 | 1.00 | 0.00 | XXXX | 5538 |
| ATOM | 5539 | CA | ASN B | 353 | 7.974 | 27.756 | 48.739 | 1.00 | 0.00 | XXXX | 5539 |
| ATOM | 5540 | C | ASN B | 353 | 8.188 | 29.245 | 48.999 | 1.00 | 0.00 | XXXX | 5540 |
| ATOM | 5541 | O | ASN B | 353 | 7.231 | 30.016 | 49.065 | 1.00 | 0.00 | XXXX | 5541 |
| ATOM | 5542 | CB | ASN B | 353 | 6.916 | 27.206 | 49.701 | 1.00 | 0.00 | XXXX | 5542 |
| ATOM | 5543 | CG | ASN B | 353 | 7.343 | 27.289 | 51.157 | 1.00 | 0.00 | XXXX | 5543 |
| ATOM | 5544 | OD1 | ASN B | 353 | 8.411 | 27.809 | 51.479 | 1.00 | 0.00 | XXXX | 5544 |
| ATOM | 5545 | ND2 | ASN B | 353 | 6.501 | 26.775 | 52.046 | 1.00 | 0.00 | XXXX | 5545 |
| ATOM | 5546 | N | GLY B | 354 | 9.447 | 29.645 | 49.147 | 1.00 | 0.00 | XXXX | 5546 |
| ATOM | 5547 | CA | GLY B | 354 | 9.781 | 31.042 | 49.364 | 1.00 | 0.00 | XXXX | 5547 |
| ATOM | 5548 | C | GLY B | 354 | 9.784 | 31.462 | 50.821 | 1.00 | 0.00 | XXXX | 5548 |
| ATOM | 5549 | O | GLY B | 354 | 10.135 | 32.597 | 51.144 | 1.00 | 0.00 | XXXX | 5549 |
| ATOM | 5550 | N | GLN B | 355 | 9.391 | 30.553 | 51.707 | 1.00 | 0.00 | XXXX | 5550 |
| ATOM | 5551 | CA | GLN B | 355 | 9.433 | 30.827 | 53.140 | 1.00 | 0.00 | XXXX | 5551 |
| ATOM | 5552 | C | GLN B | 355 | 10.834 | 30.608 | 53.697 | 1.00 | 0.00 | XXXX | 5552 |
| ATOM | 5553 | O | GLN B | 355 | 11.703 | 30.060 | 53.018 | 1.00 | 0.00 | XXXX | 5553 |
| ATOM | 5554 | CB | GLN B | 355 | 8.424 | 29.956 | 53.888 | 1.00 | 0.00 | XXXX | 5554 |
| ATOM | 5555 | CG | GLN B | 355 | 6.977 | 30.310 | 53.591 | 1.00 | 0.00 | XXXX | 5555 |
| ATOM | 5556 | CD | GLN B | 355 | 6.592 | 31.672 | 54.137 | 1.00 | 0.00 | XXXX | 5556 |
| ATOM | 5557 | OE1 | GLN B | 355 | 6.669 | 31.915 | 55.340 | 1.00 | 0.00 | XXXX | 5557 |
| ATOM | 5558 | NE2 | GLN B | 355 | 6.179 | 32.569 | 53.251 | 1.00 | 0.00 | XXXX | 5558 |
| ATOM | 5559 | N | ILE B | 356 | 11.050 | 31.039 | 54.936 | 1.00 | 0.00 | XXXX | 5559 |
| ATOM | 5560 | CA | ILE B | 356 | 12.373 | 30.970 | 55.544 | 1.00 | 0.00 | XXXX | 5560 |
| ATOM | 5561 | C | ILE B | 356 | 12.469 | 29.919 | 56.643 | 1.00 | 0.00 | XXXX | 5561 |
| ATOM | 5562 | O | ILE B | 356 | 11.589 | 29.811 | 57.498 | 1.00 | 0.00 | XXXX | 5562 |
| ATOM | 5563 | CB | ILE B | 356 | 12.787 | 32.330 | 56.137 | 1.00 | 0.00 | XXXX | 5563 |
| ATOM | 5564 | CG1 | ILE B | 356 | 12.616 | 33.439 | 55.099 | 1.00 | 0.00 | XXXX | 5564 |
| ATOM | 5565 | CG2 | ILE B | 356 | 14.226 | 32.280 | 56.637 | 1.00 | 0.00 | XXXX | 5565 |
| ATOM | 5566 | CD1 | ILE B | 356 | 13.444 | 33.238 | 53.847 | 1.00 | 0.00 | XXXX | 5566 |
| ATOM | 5567 | N | ARG B | 357 | 13.548 | 29.146 | 56.605 | 1.00 | 0.00 | XXXX | 5567 |
| ATOM | 5568 | CA | ARG B | 357 | 13.885 | 28.232 | 57.688 | 1.00 | 0.00 | XXXX | 5568 |
| ATOM | 5569 | C | ARG B | 357 | 14.977 | 28.855 | 58.548 | 1.00 | 0.00 | XXXX | 5569 |
| ATOM | 5570 | O | ARG B | 357 | 16.091 | 29.086 | 58.078 | 1.00 | 0.00 | XXXX | 5570 |
| ATOM | 5571 | CB | ARG B | 357 | 14.335 | 26.877 | 57.136 | 1.00 | 0.00 | XXXX | 5571 |
| ATOM | 5572 | CG | ARG B | 357 | 14.807 | 25.888 | 58.192 | 1.00 | 0.00 | XXXX | 5572 |
| ATOM | 5573 | CD | ARG B | 357 | 15.183 | 24.558 | 57.557 | 1.00 | 0.00 | XXXX | 5573 |
| ATOM | 5574 | NE | ARG B | 357 | 15.688 | 23.594 | 58.531 | 1.00 | 0.00 | XXXX | 5574 |
| ATOM | 5575 | CZ | ARG B | 357 | 16.976 | 23.328 | 58.723 | 1.00 | 0.00 | XXXX | 5575 |
| ATOM | 5576 | NH1 | ARG B | 357 | 17.898 | 23.950 | 58.001 | 1.00 | 0.00 | XXXX | 5576 |
| ATOM | 5577 | NH2 | ARG B | 357 | 17.343 | 22.436 | 59.632 | 1.00 | 0.00 | XXXX | 5577 |
| ATOM | 5578 | N | GLU B | 358 | 14.654 | 29.137 | 59.806 | 1.00 | 0.00 | XXXX | 5578 |
| ATOM | 5579 | CA | GLU B | 358 | 15.604 | 29.787 | 60.700 | 1.00 | 0.00 | XXXX | 5579 |
| ATOM | 5580 | C | GLU B | 358 | 16.749 | 28.843 | 61.047 | 1.00 | 0.00 | XXXX | 5580 |

-continued

| | | | | | | | | | | |
|---|---|---|---|---|---|---|---|---|---|---|
| ATOM | 5581 | O | GLU B | 358 | 16.526 | 27.702 | 61.450 | 1.00 | 0.00 | XXXX | 5581 |
| ATOM | 5582 | CB | GLU B | 358 | 14.904 | 30.266 | 61.973 | 1.00 | 0.00 | XXXX | 5582 |
| ATOM | 5583 | CG | GLU B | 358 | 15.826 | 30.928 | 62.985 | 1.00 | 0.00 | XXXX | 5583 |
| ATOM | 5584 | CD | GLU B | 358 | 15.075 | 31.477 | 64.183 | 1.00 | 0.00 | XXXX | 5584 |
| ATOM | 5585 | OE1 | GLU B | 358 | 14.379 | 32.503 | 64.032 | 1.00 | 0.00 | XXXX | 5585 |
| ATOM | 5586 | OE2 | GLU B | 358 | 15.178 | 30.880 | 65.276 | 1.00 | 0.00 | XXXX | 5586 |
| ATOM | 5587 | N | LEU B | 359 | 17.975 | 29.327 | 60.882 | 1.00 | 0.00 | XXXX | 5587 |
| ATOM | 5588 | CA | LEU B | 359 | 19.161 | 28.532 | 61.175 | 1.00 | 0.00 | XXXX | 5588 |
| ATOM | 5589 | C | LEU B | 359 | 19.821 | 28.978 | 62.474 | 1.00 | 0.00 | XXXX | 5589 |
| ATOM | 5590 | O | LEU B | 359 | 20.482 | 28.190 | 63.149 | 1.00 | 0.00 | XXXX | 5590 |
| ATOM | 5591 | CB | LEU B | 359 | 20.163 | 28.628 | 60.022 | 1.00 | 0.00 | XXXX | 5591 |
| ATOM | 5592 | CG | LEU B | 359 | 19.655 | 28.235 | 58.632 | 1.00 | 0.00 | XXXX | 5592 |
| ATOM | 5593 | CD1 | LEU B | 359 | 20.733 | 28.465 | 57.584 | 1.00 | 0.00 | XXXX | 5593 |
| ATOM | 5594 | CD2 | LEU B | 359 | 19.182 | 26.789 | 58.613 | 1.00 | 0.00 | XXXX | 5594 |
| ATOM | 5595 | N | TRP B | 360 | 19.634 | 30.246 | 62.820 | 1.00 | 0.00 | XXXX | 5595 |
| ATOM | 5596 | CA | TRP B | 360 | 20.316 | 30.839 | 63.962 | 1.00 | 0.00 | XXXX | 5596 |
| ATOM | 5597 | C | TRP B | 360 | 19.603 | 32.107 | 64.417 | 1.00 | 0.00 | XXXX | 5597 |
| ATOM | 5598 | O | TRP B | 360 | 19.006 | 32.813 | 63.606 | 1.00 | 0.00 | XXXX | 5598 |
| ATOM | 5599 | CB | TRP B | 360 | 21.773 | 31.150 | 63.606 | 1.00 | 0.00 | XXXX | 5599 |
| ATOM | 5600 | CG | TRP B | 360 | 22.544 | 31.817 | 64.706 | 1.00 | 0.00 | XXXX | 5600 |
| ATOM | 5601 | CD1 | TRP B | 360 | 23.321 | 31.208 | 65.647 | 1.00 | 0.00 | XXXX | 5601 |
| ATOM | 5602 | CD2 | TRP B | 360 | 22.611 | 33.223 | 64.979 | 1.00 | 0.00 | XXXX | 5602 |
| ATOM | 5603 | NE1 | TRP B | 360 | 23.869 | 32.146 | 66.488 | 1.00 | 0.00 | XXXX | 5603 |
| ATOM | 5604 | CE2 | TRP B | 360 | 23.448 | 33.391 | 66.101 | 1.00 | 0.00 | XXXX | 5604 |
| ATOM | 5605 | CE3 | TRP B | 360 | 22.043 | 34.355 | 64.386 | 1.00 | 0.00 | XXXX | 5605 |
| ATOM | 5606 | CZ2 | TRP B | 360 | 23.733 | 34.644 | 66.639 | 1.00 | 0.00 | XXXX | 5606 |
| ATOM | 5607 | CZ3 | TRP B | 360 | 22.326 | 35.599 | 64.923 | 1.00 | 0.00 | XXXX | 5607 |
| ATOM | 5608 | CH2 | TRP B | 360 | 23.164 | 35.733 | 66.038 | 1.00 | 0.00 | XXXX | 5608 |
| ATOM | 5609 | N | LYS B | 361 | 19.668 | 32.390 | 65.714 | 1.00 | 0.00 | XXXX | 5609 |
| ATOM | 5610 | CA | LYS B | 361 | 19.119 | 33.630 | 66.251 | 1.00 | 0.00 | XXXX | 5610 |
| ATOM | 5611 | C | LYS B | 361 | 19.740 | 33.974 | 67.600 | 1.00 | 0.00 | XXXX | 5611 |
| ATOM | 5612 | O | LYS B | 361 | 20.345 | 33.121 | 68.248 | 1.00 | 0.00 | XXXX | 5612 |
| ATOM | 5613 | CB | LYS B | 361 | 17.599 | 33.530 | 66.396 | 1.00 | 0.00 | XXXX | 5613 |
| ATOM | 5614 | CG | LYS B | 361 | 17.151 | 32.647 | 67.551 | 1.00 | 0.00 | XXXX | 5614 |
| ATOM | 5615 | CD | LYS B | 361 | 15.664 | 32.800 | 67.826 | 1.00 | 0.00 | XXXX | 5615 |
| ATOM | 5616 | CE | LYS B | 361 | 15.195 | 31.819 | 68.888 | 1.00 | 0.00 | XXXX | 5616 |
| ATOM | 5617 | NZ | LYS B | 361 | 13.750 | 31.999 | 69.205 | 1.00 | 0.00 | XXXX | 5617 |
| ATOM | 5618 | N | THR B | 362 | 19.588 | 35.228 | 68.016 | 1.00 | 0.00 | XXXX | 5618 |
| ATOM | 5619 | CA | THR B | 362 | 19.967 | 35.630 | 69.364 | 1.00 | 0.00 | XXXX | 5619 |
| ATOM | 5620 | C | THR B | 362 | 18.896 | 35.174 | 70.352 | 1.00 | 0.00 | XXXX | 5620 |
| ATOM | 5621 | O | THR B | 362 | 17.724 | 35.058 | 69.996 | 1.00 | 0.00 | XXXX | 5621 |
| ATOM | 5622 | CB | THR B | 362 | 20.165 | 37.154 | 69.476 | 1.00 | 0.00 | XXXX | 5622 |
| ATOM | 5623 | OG1 | THR B | 362 | 18.979 | 37.830 | 69.042 | 1.00 | 0.00 | XXXX | 5623 |
| ATOM | 5624 | CG2 | THR B | 362 | 21.342 | 37.600 | 68.621 | 1.00 | 0.00 | XXXX | 5624 |
| ATOM | 5625 | N | ASN B | 363 | 19.302 | 34.920 | 71.591 | 1.00 | 0.00 | XXXX | 5625 |
| ATOM | 5626 | CA | ASN B | 363 | 18.384 | 34.421 | 72.608 | 1.00 | 0.00 | XXXX | 5626 |
| ATOM | 5627 | C | ASN B | 363 | 17.522 | 35.532 | 73.194 | 1.00 | 0.00 | XXXX | 5627 |
| ATOM | 5628 | O | ASN B | 363 | 16.513 | 35.271 | 73.851 | 1.00 | 0.00 | XXXX | 5628 |
| ATOM | 5629 | CB | ASN B | 363 | 19.159 | 33.713 | 73.719 | 1.00 | 0.00 | XXXX | 5629 |
| ATOM | 5630 | CG | ASN B | 363 | 19.779 | 32.409 | 73.255 | 1.00 | 0.00 | XXXX | 5630 |
| ATOM | 5631 | OD1 | ASN B | 363 | 19.142 | 31.619 | 72.557 | 1.00 | 0.00 | XXXX | 5631 |
| ATOM | 5632 | ND2 | ASN B | 363 | 21.031 | 32.180 | 73.636 | 1.00 | 0.00 | XXXX | 5632 |
| ATOM | 5633 | N | LYS B | 364 | 17.928 | 36.773 | 72.950 | 1.00 | 0.00 | XXXX | 5633 |
| ATOM | 5634 | CA | LYS B | 364 | 17.171 | 37.935 | 73.393 | 1.00 | 0.00 | XXXX | 5634 |
| ATOM | 5635 | C | LYS B | 364 | 17.221 | 39.024 | 72.333 | 1.00 | 0.00 | XXXX | 5635 |
| ATOM | 5636 | O | LYS B | 364 | 18.056 | 38.973 | 71.428 | 1.00 | 0.00 | XXXX | 5636 |
| ATOM | 5637 | CB | LYS B | 364 | 17.724 | 38.479 | 74.712 | 1.00 | 0.00 | XXXX | 5637 |
| ATOM | 5638 | CG | LYS B | 364 | 17.678 | 37.514 | 75.881 | 1.00 | 0.00 | XXXX | 5638 |
| ATOM | 5639 | CD | LYS B | 364 | 18.339 | 38.139 | 77.101 | 1.00 | 0.00 | XXXX | 5639 |
| ATOM | 5640 | CE | LYS B | 364 | 18.336 | 37.199 | 78.295 | 1.00 | 0.00 | XXXX | 5640 |
| ATOM | 5641 | NZ | LYS B | 364 | 19.027 | 37.808 | 79.468 | 1.00 | 0.00 | XXXX | 5641 |
| ATOM | 5642 | N | PRO B | 365 | 16.324 | 40.014 | 72.436 | 1.00 | 0.00 | XXXX | 5642 |
| ATOM | 5643 | CA | PRO B | 365 | 16.431 | 41.187 | 71.565 | 1.00 | 0.00 | XXXX | 5643 |
| ATOM | 5644 | C | PRO B | 365 | 17.758 | 41.905 | 71.793 | 1.00 | 0.00 | XXXX | 5644 |
| ATOM | 5645 | O | PRO B | 365 | 18.257 | 41.920 | 72.919 | 1.00 | 0.00 | XXXX | 5645 |
| ATOM | 5646 | CB | PRO B | 365 | 15.246 | 42.056 | 71.996 | 1.00 | 0.00 | XXXX | 5646 |
| ATOM | 5647 | CG | PRO B | 365 | 14.268 | 41.092 | 72.587 | 1.00 | 0.00 | XXXX | 5647 |
| ATOM | 5648 | CD | PRO B | 365 | 15.104 | 40.042 | 73.261 | 1.00 | 0.00 | XXXX | 5648 |
| ATOM | 5649 | N | VAL B | 366 | 18.318 | 42.491 | 70.741 | 1.00 | 0.00 | XXXX | 5649 |
| ATOM | 5650 | CA | VAL B | 366 | 19.596 | 43.184 | 70.846 | 1.00 | 0.00 | XXXX | 5650 |
| ATOM | 5651 | C | VAL B | 366 | 19.398 | 44.693 | 70.854 | 1.00 | 0.00 | XXXX | 5651 |
| ATOM | 5652 | O | VAL B | 366 | 18.644 | 45.233 | 70.043 | 1.00 | 0.00 | XXXX | 5652 |
| ATOM | 5653 | CB | VAL B | 366 | 20.538 | 42.802 | 69.688 | 1.00 | 0.00 | XXXX | 5653 |
| ATOM | 5654 | CG1 | VAL B | 366 | 21.865 | 43.537 | 69.816 | 1.00 | 0.00 | XXXX | 5654 |
| ATOM | 5655 | CG2 | VAL B | 366 | 20.757 | 41.299 | 69.660 | 1.00 | 0.00 | XXXX | 5655 |
| ATOM | 5656 | N | LYS B | 367 | 20.074 | 45.373 | 71.775 | 1.00 | 0.00 | XXXX | 5656 |
| ATOM | 5657 | CA | LYS B | 367 | 20.037 | 46.829 | 71.818 | 1.00 | 0.00 | XXXX | 5657 |
| ATOM | 5658 | C | LYS B | 367 | 20.637 | 47.405 | 70.542 | 1.00 | 0.00 | XXXX | 5658 |
| ATOM | 5659 | O | LYS B | 367 | 21.728 | 47.007 | 70.134 | 1.00 | 0.00 | XXXX | 5659 |

| | | | | | | | | | | |
|---|---|---|---|---|---|---|---|---|---|---|
| ATOM | 5660 | CB | LYS B | 367 | 20.785 | 47.360 | 73.044 | 1.00 | 0.00 XXXX | 5660 |
| ATOM | 5661 | CG | LYS B | 367 | 20.649 | 48.862 | 73.247 | 1.00 | 0.00 XXXX | 5661 |
| ATOM | 5662 | CD | LYS B | 367 | 21.406 | 49.330 | 74.482 | 1.00 | 0.00 XXXX | 5662 |
| ATOM | 5663 | CE | LYS B | 367 | 21.058 | 50.770 | 74.833 | 1.00 | 0.00 XXXX | 5663 |
| ATOM | 5664 | NZ | LYS B | 367 | 21.396 | 51.717 | 73.735 | 1.00 | 0.00 XXXX | 5664 |
| ATOM | 5665 | N | PRO B | 368 | 19.925 | 48.348 | 69.909 | 1.00 | 0.00 XXXX | 5665 |
| ATOM | 5666 | CA | PRO B | 368 | 20.414 | 48.981 | 68.679 | 1.00 | 0.00 XXXX | 5666 |
| ATOM | 5667 | C | PRO B | 368 | 21.680 | 49.801 | 68.911 | 1.00 | 0.00 XXXX | 5667 |
| ATOM | 5668 | O | PRO B | 368 | 21.770 | 50.544 | 69.888 | 1.00 | 0.00 XXXX | 5668 |
| ATOM | 5669 | CB | PRO B | 368 | 19.247 | 49.878 | 68.257 | 1.00 | 0.00 XXXX | 5669 |
| ATOM | 5670 | CG | PRO B | 368 | 18.490 | 50.136 | 69.518 | 1.00 | 0.00 XXXX | 5670 |
| ATOM | 5671 | CD | PRO B | 368 | 18.610 | 48.873 | 70.317 | 1.00 | 0.00 XXXX | 5671 |
| ATOM | 5672 | N | ASP B | 369 | 22.641 | 49.657 | 68.004 | 1.00 | 0.00 XXXX | 5672 |
| ATOM | 5673 | CA | ASP B | 369 | 23.944 | 50.300 | 68.124 | 1.00 | 0.00 XXXX | 5673 |
| ATOM | 5674 | C | ASP B | 369 | 24.378 | 50.811 | 66.753 | 1.00 | 0.00 XXXX | 5674 |
| ATOM | 5675 | O | ASP B | 369 | 25.296 | 50.263 | 66.143 | 1.00 | 0.00 XXXX | 5675 |
| ATOM | 5676 | CB | ASP B | 369 | 24.972 | 49.318 | 68.690 | 1.00 | 0.00 XXXX | 5676 |
| ATOM | 5677 | CG | ASP B | 369 | 26.305 | 49.971 | 68.997 | 1.00 | 0.00 XXXX | 5677 |
| ATOM | 5678 | OD1 | ASP B | 369 | 26.394 | 51.216 | 68.939 | 1.00 | 0.00 XXXX | 5678 |
| ATOM | 5679 | OD2 | ASP B | 369 | 27.266 | 49.232 | 69.295 | 1.00 | 0.00 XXXX | 5679 |
| ATOM | 5680 | N | PRO B | 370 | 23.709 | 51.864 | 66.264 | 1.00 | 0.00 XXXX | 5680 |
| ATOM | 5681 | CA | PRO B | 370 | 23.890 | 52.355 | 64.892 | 1.00 | 0.00 XXXX | 5681 |
| ATOM | 5682 | C | PRO B | 370 | 25.311 | 52.818 | 64.585 | 1.00 | 0.00 XXXX | 5682 |
| ATOM | 5683 | O | PRO B | 370 | 25.739 | 52.726 | 63.435 | 1.00 | 0.00 XXXX | 5683 |
| ATOM | 5684 | CB | PRO B | 370 | 22.910 | 53.532 | 64.809 | 1.00 | 0.00 XXXX | 5684 |
| ATOM | 5685 | CG | PRO B | 370 | 22.658 | 53.930 | 66.227 | 1.00 | 0.00 XXXX | 5685 |
| ATOM | 5686 | CD | PRO B | 370 | 22.711 | 52.654 | 67.004 | 1.00 | 0.00 XXXX | 5686 |
| ATOM | 5687 | N | TYR B | 371 | 26.029 | 53.305 | 65.591 | 1.00 | 0.00 XXXX | 5687 |
| ATOM | 5688 | CA | TYR B | 371 | 27.397 | 53.764 | 65.385 | 1.00 | 0.00 XXXX | 5688 |
| ATOM | 5689 | C | TYR B | 371 | 28.416 | 52.706 | 65.800 | 1.00 | 0.00 XXXX | 5689 |
| ATOM | 5690 | O | TYR B | 371 | 29.620 | 52.963 | 65.805 | 1.00 | 0.00 XXXX | 5690 |
| ATOM | 5691 | CB | TYR B | 371 | 27.641 | 55.070 | 66.143 | 1.00 | 0.00 XXXX | 5691 |
| ATOM | 5692 | CG | TYR B | 371 | 26.967 | 56.264 | 65.504 | 1.00 | 0.00 XXXX | 5692 |
| ATOM | 5693 | CD1 | TYR B | 371 | 25.713 | 56.689 | 65.923 | 1.00 | 0.00 XXXX | 5693 |
| ATOM | 5694 | CD2 | TYR B | 371 | 27.580 | 56.955 | 64.466 | 1.00 | 0.00 XXXX | 5694 |
| ATOM | 5695 | CE1 | TYR B | 371 | 25.094 | 57.777 | 65.335 | 1.00 | 0.00 XXXX | 5695 |
| ATOM | 5696 | CE2 | TYR B | 371 | 26.969 | 58.044 | 63.871 | 1.00 | 0.00 XXXX | 5696 |
| ATOM | 5697 | CZ | TYR B | 371 | 25.725 | 58.450 | 64.310 | 1.00 | 0.00 XXXX | 5697 |
| ATOM | 5698 | OH | TYR B | 371 | 25.111 | 59.532 | 63.723 | 1.00 | 0.00 XXXX | 5698 |
| ATOM | 5699 | N | LEU B | 372 | 27.923 | 51.517 | 66.133 | 1.00 | 0.00 XXXX | 5699 |
| ATOM | 5700 | CA | LEU B | 372 | 28.780 | 50.382 | 66.467 | 1.00 | 0.00 XXXX | 5700 |
| ATOM | 5701 | C | LEU B | 372 | 29.765 | 50.712 | 67.586 | 1.00 | 0.00 XXXX | 5701 |
| ATOM | 5702 | O | LEU B | 372 | 30.940 | 50.352 | 67.518 | 1.00 | 0.00 XXXX | 5702 |
| ATOM | 5703 | CB | LEU B | 372 | 29.534 | 49.909 | 65.224 | 1.00 | 0.00 XXXX | 5703 |
| ATOM | 5704 | CG | LEU B | 372 | 28.644 | 49.388 | 64.093 | 1.00 | 0.00 XXXX | 5704 |
| ATOM | 5705 | CD1 | LEU B | 372 | 29.480 | 48.932 | 62.907 | 1.00 | 0.00 XXXX | 5705 |
| ATOM | 5706 | CD2 | LEU B | 372 | 27.749 | 48.261 | 64.590 | 1.00 | 0.00 XXXX | 5706 |
| ATOM | 5707 | N | LYS B | 373 | 29.272 | 51.394 | 68.614 | 1.00 | 0.00 XXXX | 5707 |
| ATOM | 5708 | CA | LYS B | 373 | 30.104 | 51.803 | 69.739 | 1.00 | 0.00 XXXX | 5708 |
| ATOM | 5709 | C | LYS B | 373 | 30.624 | 50.597 | 70.514 | 1.00 | 0.00 XXXX | 5709 |
| ATOM | 5710 | O | LYS B | 373 | 31.689 | 50.652 | 71.126 | 1.00 | 0.00 XXXX | 5710 |
| ATOM | 5711 | CB | LYS B | 373 | 29.315 | 52.720 | 70.675 | 1.00 | 0.00 XXXX | 5711 |
| ATOM | 5712 | CG | LYS B | 373 | 28.883 | 54.031 | 70.042 | 1.00 | 0.00 XXXX | 5712 |
| ATOM | 5713 | CD | LYS B | 373 | 27.994 | 54.827 | 70.984 | 1.00 | 0.00 XXXX | 5713 |
| ATOM | 5714 | CE | LYS B | 373 | 27.249 | 55.927 | 70.246 | 1.00 | 0.00 XXXX | 5714 |
| ATOM | 5715 | NZ | LYS B | 373 | 26.331 | 56.676 | 71.149 | 1.00 | 0.00 XXXX | 5715 |
| ATOM | 5716 | N | GLY B | 374 | 29.864 | 49.506 | 70.479 | 1.00 | 0.00 XXXX | 5716 |
| ATOM | 5717 | CA | GLY B | 374 | 30.224 | 48.297 | 71.198 | 1.00 | 0.00 XXXX | 5717 |
| ATOM | 5718 | C | GLY B | 374 | 31.223 | 47.435 | 70.452 | 1.00 | 0.00 XXXX | 5718 |
| ATOM | 5719 | O | GLY B | 374 | 31.608 | 46.365 | 70.925 | 1.00 | 0.00 XXXX | 5719 |
| ATOM | 5720 | N | TYR B | 375 | 31.647 | 47.901 | 69.283 | 1.00 | 0.00 XXXX | 5720 |
| ATOM | 5721 | CA | TYR B | 375 | 32.574 | 47.141 | 68.454 | 1.00 | 0.00 XXXX | 5721 |
| ATOM | 5722 | C | TYR B | 375 | 33.906 | 47.864 | 68.310 | 1.00 | 0.00 XXXX | 5722 |
| ATOM | 5723 | O | TYR B | 375 | 34.023 | 48.866 | 67.601 | 1.00 | 0.00 XXXX | 5723 |
| ATOM | 5724 | CB | TYR B | 375 | 31.958 | 46.858 | 67.084 | 1.00 | 0.00 XXXX | 5724 |
| ATOM | 5725 | CG | TYR B | 375 | 30.703 | 46.023 | 67.178 | 1.00 | 0.00 XXXX | 5725 |
| ATOM | 5726 | CD1 | TYR B | 375 | 30.769 | 44.635 | 67.171 | 1.00 | 0.00 XXXX | 5726 |
| ATOM | 5727 | CD2 | TYR B | 375 | 29.455 | 46.619 | 67.295 | 1.00 | 0.00 XXXX | 5727 |
| ATOM | 5728 | CE1 | TYR B | 375 | 29.626 | 43.865 | 67.266 | 1.00 | 0.00 XXXX | 5728 |
| ATOM | 5729 | CE2 | TYR B | 375 | 28.306 | 45.856 | 67.391 | 1.00 | 0.00 XXXX | 5729 |
| ATOM | 5730 | CZ | TYR B | 375 | 28.397 | 44.481 | 67.376 | 1.00 | 0.00 XXXX | 5730 |
| ATOM | 5731 | OH | TYR B | 375 | 27.256 | 43.719 | 67.471 | 1.00 | 0.00 XXXX | 5731 |
| ATOM | 5732 | N | GLU B | 376 | 34.904 | 47.329 | 69.003 | 1.00 | 0.00 XXXX | 5732 |
| ATOM | 5733 | CA | GLU B | 376 | 36.227 | 47.930 | 69.107 | 1.00 | 0.00 XXXX | 5733 |
| ATOM | 5734 | C | GLU B | 376 | 36.892 | 48.164 | 67.749 | 1.00 | 0.00 XXXX | 5734 |
| ATOM | 5735 | O | GLU B | 376 | 37.684 | 49.093 | 67.595 | 1.00 | 0.00 XXXX | 5735 |
| ATOM | 5736 | CB | GLU B | 376 | 37.106 | 47.034 | 69.989 | 1.00 | 0.00 XXXX | 5736 |
| ATOM | 5737 | CG | GLU B | 376 | 38.489 | 47.568 | 70.297 | 1.00 | 0.00 XXXX | 5737 |
| ATOM | 5738 | CD | GLU B | 376 | 39.505 | 47.192 | 69.240 | 1.00 | 0.00 XXXX | 5738 |

-continued

| | | | | | | | | | | |
|---|---|---|---|---|---|---|---|---|---|---|
| ATOM | 5739 | OE1 | GLU B | 376 | 39.233 | 46.260 | 68.452 | 1.00 | 0.00 | XXXX | 5739 |
| ATOM | 5740 | OE2 | GLU B | 376 | 40.585 | 47.815 | 69.214 | 1.00 | 0.00 | XXXX | 5740 |
| ATOM | 5741 | N | TRP B | 377 | 36.568 | 47.322 | 66.773 | 1.00 | 0.00 | XXXX | 5741 |
| ATOM | 5742 | CA | TRP B | 377 | 37.154 | 47.420 | 65.437 | 1.00 | 0.00 | XXXX | 5742 |
| ATOM | 5743 | C | TRP B | 377 | 36.473 | 48.451 | 64.529 | 1.00 | 0.00 | XXXX | 5743 |
| ATOM | 5744 | O | TRP B | 377 | 36.962 | 48.742 | 63.438 | 1.00 | 0.00 | XXXX | 5744 |
| ATOM | 5745 | CB | TRP B | 377 | 37.119 | 46.050 | 64.756 | 1.00 | 0.00 | XXXX | 5745 |
| ATOM | 5746 | CG | TRP B | 377 | 35.757 | 45.424 | 64.768 | 1.00 | 0.00 | XXXX | 5746 |
| ATOM | 5747 | CD1 | TRP B | 377 | 35.297 | 44.479 | 65.637 | 1.00 | 0.00 | XXXX | 5747 |
| ATOM | 5748 | CD2 | TRP B | 377 | 34.672 | 45.713 | 63.878 | 1.00 | 0.00 | XXXX | 5748 |
| ATOM | 5749 | NE1 | TRP B | 377 | 33.995 | 44.156 | 65.340 | 1.00 | 0.00 | XXXX | 5749 |
| ATOM | 5750 | CE2 | TRP B | 377 | 33.588 | 44.901 | 64.264 | 1.00 | 0.00 | XXXX | 5750 |
| ATOM | 5751 | CE3 | TRP B | 377 | 34.514 | 46.578 | 62.789 | 1.00 | 0.00 | XXXX | 5751 |
| ATOM | 5752 | CZ2 | TRP B | 377 | 32.362 | 44.926 | 63.601 | 1.00 | 0.00 | XXXX | 5752 |
| ATOM | 5753 | CZ3 | TRP B | 377 | 33.296 | 46.602 | 62.133 | 1.00 | 0.00 | XXXX | 5753 |
| ATOM | 5754 | CH2 | TRP B | 377 | 32.236 | 45.781 | 62.541 | 1.00 | 0.00 | XXXX | 5754 |
| ATOM | 5755 | N | ALA B | 378 | 35.349 | 48.999 | 64.981 | 1.00 | 0.00 | XXXX | 5755 |
| ATOM | 5756 | CA | ALA B | 378 | 34.553 | 49.918 | 64.166 | 1.00 | 0.00 | XXXX | 5756 |
| ATOM | 5757 | C | ALA B | 378 | 34.846 | 51.388 | 64.462 | 1.00 | 0.00 | XXXX | 5757 |
| ATOM | 5758 | O | ALA B | 378 | 34.076 | 52.269 | 64.078 | 1.00 | 0.00 | XXXX | 5758 |
| ATOM | 5759 | CB | ALA B | 378 | 33.067 | 49.634 | 64.362 | 1.00 | 0.00 | XXXX | 5759 |
| ATOM | 5760 | N | GLN B | 379 | 35.960 | 51.643 | 65.141 | 1.00 | 0.00 | XXXX | 5760 |
| ATOM | 5761 | CA | GLN B | 379 | 36.297 | 52.976 | 65.641 | 1.00 | 0.00 | XXXX | 5761 |
| ATOM | 5762 | C | GLN B | 379 | 36.161 | 54.125 | 64.634 | 1.00 | 0.00 | XXXX | 5762 |
| ATOM | 5763 | O | GLN B | 379 | 35.499 | 55.122 | 64.919 | 1.00 | 0.00 | XXXX | 5763 |
| ATOM | 5764 | CB | GLN B | 379 | 37.726 | 52.965 | 66.190 | 1.00 | 0.00 | XXXX | 5764 |
| ATOM | 5765 | CG | GLN B | 379 | 38.205 | 54.314 | 66.694 | 1.00 | 0.00 | XXXX | 5765 |
| ATOM | 5766 | CD | GLN B | 379 | 37.477 | 54.757 | 67.946 | 1.00 | 0.00 | XXXX | 5766 |
| ATOM | 5767 | OE1 | GLN B | 379 | 37.310 | 53.982 | 68.888 | 1.00 | 0.00 | XXXX | 5767 |
| ATOM | 5768 | NE2 | GLN B | 379 | 37.041 | 56.011 | 67.965 | 1.00 | 0.00 | XXXX | 5768 |
| ATOM | 5769 | N | GLY B | 380 | 36.778 | 53.996 | 63.464 | 1.00 | 0.00 | XXXX | 5769 |
| ATOM | 5770 | CA | GLY B | 380 | 36.863 | 55.119 | 62.543 | 1.00 | 0.00 | XXXX | 5770 |
| ATOM | 5771 | C | GLY B | 380 | 35.841 | 55.183 | 61.420 | 1.00 | 0.00 | XXXX | 5771 |
| ATOM | 5772 | O | GLY B | 380 | 35.891 | 56.089 | 60.589 | 1.00 | 0.00 | XXXX | 5772 |
| ATOM | 5773 | N | LEU B | 381 | 34.903 | 54.241 | 61.405 | 1.00 | 0.00 | XXXX | 5773 |
| ATOM | 5774 | CA | LEU B | 381 | 33.995 | 54.067 | 60.271 | 1.00 | 0.00 | XXXX | 5774 |
| ATOM | 5775 | C | LEU B | 381 | 33.143 | 55.292 | 59.914 | 1.00 | 0.00 | XXXX | 5775 |
| ATOM | 5776 | O | LEU B | 381 | 33.050 | 55.658 | 58.742 | 1.00 | 0.00 | XXXX | 5776 |
| ATOM | 5777 | CB | LEU B | 381 | 33.075 | 52.872 | 60.531 | 1.00 | 0.00 | XXXX | 5777 |
| ATOM | 5778 | CG | LEU B | 381 | 33.768 | 51.508 | 60.548 | 1.00 | 0.00 | XXXX | 5778 |
| ATOM | 5779 | CD1 | LEU B | 381 | 32.763 | 50.391 | 60.773 | 1.00 | 0.00 | XXXX | 5779 |
| ATOM | 5780 | CD2 | LEU B | 381 | 34.538 | 51.289 | 59.255 | 1.00 | 0.00 | XXXX | 5780 |
| ATOM | 5781 | N | SER B | 382 | 32.520 | 55.919 | 60.907 | 1.00 | 0.00 | XXXX | 5781 |
| ATOM | 5782 | CA | SER B | 382 | 31.584 | 57.011 | 60.635 | 1.00 | 0.00 | XXXX | 5782 |
| ATOM | 5783 | C | SER B | 382 | 32.279 | 58.353 | 60.404 | 1.00 | 0.00 | XXXX | 5783 |
| ATOM | 5784 | O | SER B | 382 | 31.738 | 59.226 | 59.723 | 1.00 | 0.00 | XXXX | 5784 |
| ATOM | 5785 | CB | SER B | 382 | 30.575 | 57.148 | 61.779 | 1.00 | 0.00 | XXXX | 5785 |
| ATOM | 5786 | OG | SER B | 382 | 31.206 | 57.579 | 62.972 | 1.00 | 0.00 | XXXX | 5786 |
| ATOM | 5787 | N | GLU B | 383 | 33.466 | 58.513 | 60.983 | 1.00 | 0.00 | XXXX | 5787 |
| ATOM | 5788 | CA | GLU B | 383 | 34.259 | 59.737 | 60.842 | 1.00 | 0.00 | XXXX | 5788 |
| ATOM | 5789 | C | GLU B | 383 | 33.647 | 60.923 | 61.587 | 1.00 | 0.00 | XXXX | 5789 |
| ATOM | 5790 | O | GLU B | 383 | 34.227 | 62.007 | 61.621 | 1.00 | 0.00 | XXXX | 5790 |
| ATOM | 5791 | CB | GLU B | 383 | 34.436 | 60.102 | 59.365 | 1.00 | 0.00 | XXXX | 5791 |
| ATOM | 5792 | CG | GLU B | 383 | 34.971 | 58.980 | 58.493 | 1.00 | 0.00 | XXXX | 5792 |
| ATOM | 5793 | CD | GLU B | 383 | 35.207 | 59.424 | 57.062 | 1.00 | 0.00 | XXXX | 5793 |
| ATOM | 5794 | OE1 | GLU B | 383 | 34.692 | 58.759 | 56.138 | 1.00 | 0.00 | XXXX | 5794 |
| ATOM | 5795 | OE2 | GLU B | 383 | 35.908 | 60.438 | 56.862 | 1.00 | 0.00 | XXXX | 5795 |
| ATOM | 5796 | N | GLN B | 384 | 32.476 | 60.715 | 62.181 | 1.00 | 0.00 | XXXX | 5796 |
| ATOM | 5797 | CA | GLN B | 384 | 31.789 | 61.776 | 62.908 | 1.00 | 0.00 | XXXX | 5797 |
| ATOM | 5798 | C | GLN B | 384 | 32.336 | 61.924 | 64.326 | 1.00 | 0.00 | XXXX | 5798 |
| ATOM | 5799 | O | GLN B | 384 | 32.753 | 60.946 | 64.945 | 1.00 | 0.00 | XXXX | 5799 |
| ATOM | 5800 | CB | GLN B | 384 | 30.285 | 61.504 | 62.951 | 1.00 | 0.00 | XXXX | 5800 |
| ATOM | 5801 | CG | GLN B | 384 | 29.655 | 61.283 | 61.585 | 1.00 | 0.00 | XXXX | 5801 |
| ATOM | 5802 | CD | GLN B | 384 | 28.210 | 60.835 | 61.679 | 1.00 | 0.00 | XXXX | 5802 |
| ATOM | 5803 | OE1 | GLN B | 384 | 27.510 | 61.159 | 62.639 | 1.00 | 0.00 | XXXX | 5803 |
| ATOM | 5804 | NE2 | GLN B | 384 | 27.758 | 60.078 | 60.684 | 1.00 | 0.00 | XXXX | 5804 |
| ATOM | 5805 | N | GLY B | 385 | 32.332 | 63.151 | 64.834 | 1.00 | 0.00 | XXXX | 5805 |
| ATOM | 5806 | CA | GLY B | 385 | 32.811 | 63.421 | 66.177 | 1.00 | 0.00 | XXXX | 5806 |
| ATOM | 5807 | C | GLY B | 385 | 31.711 | 63.314 | 67.215 | 1.00 | 0.00 | XXXX | 5807 |
| ATOM | 5808 | O | GLY B | 385 | 30.546 | 63.102 | 66.879 | 1.00 | 0.00 | XXXX | 5808 |
| ATOM | 5809 | N | GLY B | 386 | 32.085 | 63.458 | 68.482 | 1.00 | 0.00 | XXXX | 5809 |
| ATOM | 5810 | CA | GLY B | 386 | 31.128 | 63.417 | 69.571 | 1.00 | 0.00 | XXXX | 5810 |
| ATOM | 5811 | C | GLY B | 386 | 30.850 | 62.016 | 70.080 | 1.00 | 0.00 | XXXX | 5811 |
| ATOM | 5812 | O | GLY B | 386 | 31.479 | 61.049 | 69.647 | 1.00 | 0.00 | XXXX | 5812 |
| ATOM | 5813 | N | SER B | 387 | 29.902 | 61.908 | 71.005 | 1.00 | 0.00 | XXXX | 5813 |
| ATOM | 5814 | CA | SER B | 387 | 29.535 | 60.620 | 71.583 | 1.00 | 0.00 | XXXX | 5814 |
| ATOM | 5815 | C | SER B | 387 | 28.490 | 59.911 | 70.730 | 1.00 | 0.00 | XXXX | 5815 |
| ATOM | 5816 | O | SER B | 387 | 28.114 | 58.774 | 71.014 | 1.00 | 0.00 | XXXX | 5816 |
| ATOM | 5817 | CB | SER B | 387 | 29.009 | 60.800 | 73.009 | 1.00 | 0.00 | XXXX | 5817 |

-continued

| | | | | | | | | | |
|---|---|---|---|---|---|---|---|---|---|
| ATOM | 5818 | OG | SER B | 387 | 27.770 | 61.489 | 73.010 | 1.00 | 0.00 XXXX 5818 |
| ATOM | 5819 | N | HIS B | 388 | 28.024 | 60.596 | 69.689 | 1.00 | 0.00 XXXX 5819 |
| ATOM | 5820 | CA | HIS B | 388 | 27.012 | 60.052 | 68.789 | 1.00 | 0.00 XXXX 5820 |
| ATOM | 5821 | C | HIS B | 388 | 25.683 | 59.850 | 69.511 | 1.00 | 0.00 XXXX 5821 |
| ATOM | 5822 | O | HIS B | 388 | 24.836 | 59.075 | 69.068 | 1.00 | 0.00 XXXX 5822 |
| ATOM | 5823 | CB | HIS B | 388 | 27.486 | 58.731 | 68.179 | 1.00 | 0.00 XXXX 5823 |
| ATOM | 5824 | CG | HIS B | 388 | 28.818 | 58.825 | 67.499 | 1.00 | 0.00 XXXX 5824 |
| ATOM | 5825 | ND1 | HIS B | 388 | 29.821 | 57.900 | 67.701 | 1.00 | 0.00 XXXX 5825 |
| ATOM | 5826 | CD2 | HIS B | 388 | 29.308 | 59.729 | 66.622 | 1.00 | 0.00 XXXX 5826 |
| ATOM | 5827 | CE1 | HIS B | 388 | 30.874 | 58.234 | 66.977 | 1.00 | 0.00 XXXX 5827 |
| ATOM | 5828 | NE2 | HIS B | 388 | 30.591 | 59.338 | 66.312 | 1.00 | 0.00 XXXX 5828 |
| HETATM | 5829 | C | URE C | 314 | −18.440 | 50.714 | 38.498 | 1.00 | 0.00 XXXX 5829 |
| HETATM | 5830 | O | URE C | 314 | −18.679 | 51.470 | 39.454 | 1.00 | 0.00 XXXX 5830 |
| HETATM | 5831 | N1 | URE C | 314 | −18.561 | 51.145 | 37.184 | 1.00 | 0.00 XXXX 5831 |
| HETATM | 5832 | N2 | URE C | 314 | −18.035 | 49.401 | 38.696 | 1.00 | 0.00 XXXX 5832 |
| HETATM | 5833 | HN11 | URE C | 314 | −18.810 | 51.953 | 37.029 | 1.00 | 0.00 XXXX 5833 |
| HETATM | 5834 | HN12 | URE C | 314 | −18.402 | 50.644 | 36.503 | 1.00 | 0.00 XXXX 5834 |
| HETATM | 5835 | HN21 | URE C | 314 | −17.933 | 49.049 | 39.474 | 1.00 | 0.00 XXXX 5835 |
| HETATM | 5836 | HN22 | URE C | 314 | −17.877 | 48.904 | 38.013 | 1.00 | 0.00 XXXX 5836 |
| HETATM | 5837 | C | URE D | 314 | 18.546 | 50.437 | 52.571 | 1.00 | 0.00 XXXX 5837 |
| HETATM | 5838 | O | URE D | 314 | 18.650 | 50.811 | 53.750 | 1.00 | 0.00 XXXX 5838 |
| HETATM | 5839 | N1 | URE D | 314 | 18.906 | 51.258 | 51.522 | 1.00 | 0.00 XXXX 5839 |
| HETATM | 5840 | N2 | URE D | 314 | 18.062 | 49.175 | 52.246 | 1.00 | 0.00 XXXX 5840 |
| HETATM | 5841 | HN11 | URE D | 314 | 18.822 | 50.970 | 50.716 | 1.00 | 0.00 XXXX 5841 |
| HETATM | 5842 | HN12 | URE D | 314 | 19.215 | 52.053 | 51.627 | 1.00 | 0.00 XXXX 5842 |
| HETATM | 5843 | HN21 | URE D | 314 | 17.980 | 48.892 | 51.438 | 1.00 | 0.00 XXXX 5843 |
| HETATM | 5844 | HN22 | URE D | 314 | 17.829 | 48.640 | 52.878 | 1.00 | 0.00 XXXX 5844 |
| HETATM | 5847 | O | HOH S | 1 | 15.599 | 51.447 | 60.435 | 1.00 | 0.00 XXXX 5847 |
| HETATM | 5848 | O | HOH S | 2 | 16.822 | 47.950 | 41.635 | 1.00 | 0.00 XXXX 5848 |
| HETATM | 5849 | O | HOH S | 3 | −19.774 | 42.426 | 41.534 | 1.00 | 0.00 XXXX 5849 |
| HETATM | 5850 | O | HOH S | 4 | 19.801 | 42.459 | 49.356 | 1.00 | 0.00 XXXX 5850 |
| HETATM | 5851 | O | HOH S | 5 | 11.552 | 38.612 | 56.739 | 1.00 | 0.00 XXXX 5851 |
| HETATM | 5852 | O | HOH S | 6 | 22.958 | 57.697 | 48.094 | 1.00 | 0.00 XXXX 5852 |
| HETATM | 5853 | O | HOH S | 7 | 12.376 | 41.064 | 69.244 | 1.00 | 0.00 XXXX 5853 |
| HETATM | 5854 | O | HOH S | 8 | −9.125 | 32.907 | 34.381 | 1.00 | 0.00 XXXX 5854 |
| HETATM | 5855 | O | HOH S | 9 | −15.412 | 51.659 | 30.296 | 1.00 | 0.00 XXXX 5855 |
| HETATM | 5856 | O | HOH S | 10 | −10.825 | 44.146 | 29.208 | 1.00 | 0.00 XXXX 5856 |
| HETATM | 5857 | O | HOH S | 11 | −1.130 | 60.293 | 46.232 | 1.00 | 0.00 XXXX 5857 |
| HETATM | 5858 | O | HOH S | 12 | −16.497 | 49.580 | 25.822 | 1.00 | 0.00 XXXX 5858 |
| HETATM | 5859 | O | HOH S | 13 | −17.749 | 59.470 | 24.550 | 1.00 | 0.00 XXXX 5859 |
| HETATM | 5860 | O | HOH S | 14 | 6.487 | 32.324 | 50.237 | 1.00 | 0.00 XXXX 5860 |
| HETATM | 5861 | O | HOH S | 15 | 10.789 | 43.913 | 61.570 | 1.00 | 0.00 XXXX 5861 |
| HETATM | 5862 | O | HOH S | 16 | 5.738 | 45.168 | 48.057 | 1.00 | 0.00 XXXX 5862 |
| HETATM | 5863 | O | HOH S | 17 | −25.478 | 54.047 | 22.495 | 1.00 | 0.00 XXXX 5863 |
| HETATM | 5864 | O | HOH S | 18 | −22.693 | 57.721 | 42.894 | 1.00 | 0.00 XXXX 5864 |
| HETATM | 5865 | O | HOH S | 19 | −13.136 | 46.328 | 32.985 | 1.00 | 0.00 XXXX 5865 |
| HETATM | 5866 | O | HOH S | 20 | 4.415 | 59.326 | 40.882 | 1.00 | 0.00 XXXX 5866 |
| HETATM | 5867 | O | HOH S | 21 | −3.325 | 63.403 | 25.127 | 1.00 | 0.00 XXXX 5867 |
| HETATM | 5868 | O | HOH S | 22 | −11.478 | 38.744 | 34.037 | 1.00 | 0.00 XXXX 5868 |
| HETATM | 5869 | O | HOH S | 23 | 20.036 | 35.614 | 49.410 | 1.00 | 0.00 XXXX 5869 |
| HETATM | 5870 | O | HOH S | 24 | −12.253 | 41.166 | 21.527 | 1.00 | 0.00 XXXX 5870 |
| HETATM | 5871 | O | HOH S | 25 | 14.960 | 44.898 | 60.227 | 1.00 | 0.00 XXXX 5871 |
| HETATM | 5872 | O | HOH S | 26 | 13.094 | 54.115 | 48.871 | 1.00 | 0.00 XXXX 5872 |
| HETATM | 5873 | O | HOH S | 27 | −4.263 | 59.144 | 50.114 | 1.00 | 0.00 XXXX 5873 |
| HETATM | 5874 | O | HOH S | 28 | −14.866 | 45.280 | 30.444 | 1.00 | 0.00 XXXX 5874 |
| HETATM | 5875 | O | HOH S | 29 | −5.532 | 45.224 | 42.682 | 1.00 | 0.00 XXXX 5875 |
| HETATM | 5876 | O | HOH S | 30 | 27.408 | 43.833 | 49.206 | 1.00 | 0.00 XXXX 5876 |
| HETATM | 5877 | O | HOH S | 31 | 9.164 | 32.568 | 56.320 | 1.00 | 0.00 XXXX 5877 |
| HETATM | 5878 | O | HOH S | 32 | −34.064 | 33.744 | 56.869 | 1.00 | 0.00 XXXX 5878 |
| HETATM | 5879 | O | HOH S | 33 | 14.644 | 45.745 | 48.030 | 1.00 | 0.00 XXXX 5879 |
| HETATM | 5880 | O | HOH S | 34 | 21.154 | 47.817 | 41.376 | 1.00 | 0.00 XXXX 5880 |
| HETATM | 5881 | O | HOH S | 35 | 9.477 | 47.351 | 41.376 | 1.00 | 0.00 XXXX 5881 |
| HETATM | 5882 | O | HOH S | 36 | 22.145 | 46.240 | 58.765 | 1.00 | 0.00 XXXX 5882 |
| HETATM | 5883 | O | HOH S | 37 | −33.293 | 42.556 | 23.528 | 1.00 | 0.00 XXXX 5883 |
| HETATM | 5884 | O | HOH S | 38 | −6.243 | 32.392 | 40.338 | 1.00 | 0.00 XXXX 5884 |
| HETATM | 5885 | O | HOH S | 39 | 13.265 | 46.316 | 57.730 | 1.00 | 0.00 XXXX 5885 |
| HETATM | 5886 | O | HOH S | 40 | 6.107 | 42.817 | 45.440 | 1.00 | 0.00 XXXX 5886 |
| HETATM | 5887 | O | HOH S | 41 | −19.895 | 35.575 | 41.318 | 1.00 | 0.00 XXXX 5887 |
| HETATM | 5888 | O | HOH S | 42 | −16.702 | 47.902 | 49.154 | 1.00 | 0.00 XXXX 5888 |
| HETATM | 5889 | O | HOH S | 43 | −27.218 | 44.104 | 41.714 | 1.00 | 0.00 XXXX 5889 |
| HETATM | 5890 | O | HOH S | 44 | 21.504 | 30.477 | 42.296 | 1.00 | 0.00 XXXX 5890 |
| HETATM | 5891 | O | HOH S | 45 | −32.709 | 39.943 | 57.611 | 1.00 | 0.00 XXXX 5891 |
| HETATM | 5892 | O | HOH S | 46 | 16.551 | 49.201 | 65.099 | 1.00 | 0.00 XXXX 5892 |
| HETATM | 5893 | O | HOH S | 47 | 36.313 | 49.387 | 55.652 | 1.00 | 0.00 XXXX 5893 |
| HETATM | 5894 | O | HOH S | 48 | 25.379 | 53.655 | 68.443 | 1.00 | 0.00 XXXX 5894 |
| HETATM | 5895 | O | HOH S | 49 | −5.817 | 50.835 | 13.611 | 1.00 | 0.00 XXXX 5895 |
| HETATM | 5896 | O | HOH S | 50 | −19.632 | 32.254 | 48.999 | 1.00 | 0.00 XXXX 5896 |
| HETATM | 5897 | O | HOH S | 51 | −9.878 | 43.560 | 38.787 | 1.00 | 0.00 XXXX 5897 |
| HETATM | 5898 | O | HOH S | 52 | −14.673 | 45.621 | 42.803 | 1.00 | 0.00 XXXX 5898 |

-continued

| | | | | | | | | | | | |
|---|---|---|---|---|---|---|---|---|---|---|---|
| HETATM | 5899 | O | HOH | S | 53 | 2.757 | 40.806 | 51.172 | 1.00 | 0.00 | XXXX | 5899 |
| HETATM | 5900 | O | HOH | S | 54 | 1.354 | 60.487 | 44.949 | 1.00 | 0.00 | XXXX | 5900 |
| HETATM | 5901 | O | HOH | S | 55 | −21.953 | 46.429 | 32.063 | 1.00 | 0.00 | XXXX | 5901 |
| HETATM | 5902 | O | HOH | S | 56 | −35.313 | 43.395 | 49.077 | 1.00 | 0.00 | XXXX | 5902 |
| HETATM | 5903 | O | HOH | S | 57 | 7.570 | 34.579 | 40.965 | 1.00 | 0.00 | XXXX | 5903 |
| HETATM | 5904 | O | HOH | S | 58 | −12.580 | 23.449 | 40.063 | 1.00 | 0.00 | XXXX | 5904 |
| HETATM | 5905 | O | HOH | S | 59 | −9.386 | 58.413 | 12.975 | 1.00 | 0.00 | XXXX | 5905 |
| HETATM | 5906 | O | HOH | S | 60 | 23.459 | 54.797 | 70.144 | 1.00 | 0.00 | XXXX | 5906 |
| HETATM | 5907 | O | HOH | S | 61 | 24.113 | 56.488 | 57.199 | 1.00 | 0.00 | XXXX | 5907 |
| HETATM | 5908 | O | HOH | S | 62 | −9.277 | 37.394 | 52.561 | 1.00 | 0.00 | XXXX | 5908 |
| HETATM | 5909 | O | HOH | S | 63 | 34.319 | 34.102 | 33.997 | 1.00 | 0.00 | XXXX | 5909 |
| HETATM | 5910 | O | HOH | S | 64 | −21.186 | 30.370 | 48.298 | 1.00 | 0.00 | XXXX | 5910 |
| HETATM | 5911 | O | HOH | S | 65 | −8.214 | 34.115 | 40.832 | 1.00 | 0.00 | XXXX | 5911 |
| HETATM | 5912 | O | HOH | S | 66 | 19.689 | 32.515 | 41.556 | 1.00 | 0.00 | XXXX | 5912 |
| HETATM | 5913 | O | HOH | S | 67 | 35.562 | 43.506 | 41.860 | 1.00 | 0.00 | XXXX | 5913 |
| HETATM | 5914 | O | HOH | S | 68 | −24.073 | 56.796 | 33.893 | 1.00 | 0.00 | XXXX | 5914 |
| HETATM | 5915 | O | HOH | S | 69 | 17.978 | 59.186 | 66.344 | 1.00 | 0.00 | XXXX | 5915 |
| HETATM | 5916 | O | HOH | S | 70 | −26.752 | 42.995 | 55.262 | 1.00 | 0.00 | XXXX | 5916 |
| HETATM | 5917 | O | HOH | S | 71 | 6.893 | 51.121 | 37.968 | 1.00 | 0.00 | XXXX | 5917 |
| HETATM | 5918 | O | HOH | S | 72 | 12.845 | 53.568 | 39.035 | 1.00 | 0.00 | XXXX | 5918 |
| HETATM | 5919 | O | HOH | S | 73 | −12.928 | 54.124 | 42.256 | 1.00 | 0.00 | XXXX | 5919 |
| HETATM | 5920 | O | HOH | S | 74 | 37.649 | 39.933 | 41.624 | 1.00 | 0.00 | XXXX | 5920 |
| HETATM | 5921 | O | HOH | S | 75 | 5.562 | 64.957 | 61.936 | 1.00 | 0.00 | XXXX | 5921 |
| HETATM | 5922 | O | HOH | S | 76 | 33.826 | 42.442 | 67.785 | 1.00 | 0.00 | XXXX | 5922 |
| HETATM | 5923 | O | HOH | S | 77 | −6.079 | 42.627 | 45.453 | 1.00 | 0.00 | XXXX | 5923 |
| HETATM | 5924 | O | HOH | S | 78 | 11.526 | 72.051 | 54.159 | 1.00 | 0.00 | XXXX | 5924 |
| HETATM | 5925 | O | HOH | S | 79 | 8.050 | 45.066 | 51.931 | 1.00 | 0.00 | XXXX | 5925 |
| HETATM | 5926 | O | HOH | S | 80 | 8.276 | 34.269 | 49.863 | 1.00 | 0.00 | XXXX | 5926 |
| HETATM | 5927 | O | HOH | S | 81 | −36.776 | 42.319 | 52.696 | 1.00 | 0.00 | XXXX | 5927 |
| HETATM | 5928 | O | HOH | S | 82 | −5.944 | 39.825 | 19.655 | 1.00 | 0.00 | XXXX | 5928 |
| HETATM | 5929 | O | HOH | S | 83 | 28.397 | 56.774 | 49.466 | 1.00 | 0.00 | XXXX | 5929 |
| HETATM | 5930 | O | HOH | S | 84 | −9.500 | 47.078 | 49.508 | 1.00 | 0.00 | XXXX | 5930 |
| HETATM | 5931 | O | HOH | S | 85 | −21.902 | 53.952 | 49.034 | 1.00 | 0.00 | XXXX | 5931 |
| HETATM | 5932 | O | HOH | S | 86 | −33.373 | 39.966 | 24.039 | 1.00 | 0.00 | XXXX | 5932 |
| HETATM | 5933 | O | HOH | S | 87 | −35.546 | 40.964 | 50.440 | 1.00 | 0.00 | XXXX | 5933 |
| HETATM | 5934 | O | HOH | S | 88 | −24.562 | 59.979 | 32.413 | 1.00 | 0.00 | XXXX | 5934 |
| HETATM | 5935 | O | HOH | S | 89 | 7.358 | 41.708 | 31.769 | 1.00 | 0.00 | XXXX | 5935 |
| HETATM | 5936 | O | HOH | S | 90 | −2.635 | 40.931 | 39.679 | 1.00 | 0.00 | XXXX | 5936 |
| HETATM | 5937 | O | HOH | S | 91 | −34.942 | 38.154 | 57.059 | 1.00 | 0.00 | XXXX | 5937 |
| HETATM | 5938 | O | HOH | S | 92 | −5.578 | 61.790 | 12.807 | 1.00 | 0.00 | XXXX | 5938 |
| HETATM | 5939 | O | HOH | S | 93 | −22.735 | 34.236 | 57.651 | 1.00 | 0.00 | XXXX | 5939 |
| HETATM | 5940 | O | HOH | S | 94 | 5.117 | 46.705 | 22.769 | 1.00 | 0.00 | XXXX | 5940 |
| HETATM | 5941 | O | HOH | S | 95 | −36.462 | 40.212 | 21.666 | 1.00 | 0.00 | XXXX | 5941 |
| HETATM | 5942 | O | HOH | S | 96 | −20.860 | 46.835 | 58.312 | 1.00 | 0.00 | XXXX | 5942 |
| HETATM | 5943 | O | HOH | S | 97 | −7.548 | 34.905 | 49.770 | 1.00 | 0.00 | XXXX | 5943 |
| HETATM | 5944 | O | HOH | S | 98 | −12.584 | 53.190 | 51.845 | 1.00 | 0.00 | XXXX | 5944 |
| HETATM | 5945 | O | HOH | S | 99 | 1.995 | 46.150 | 73.444 | 1.00 | 0.00 | XXXX | 5945 |
| HETATM | 5946 | O | HOH | S | 100 | −43.461 | 36.260 | 32.766 | 1.00 | 0.00 | XXXX | 5946 |
| HETATM | 5947 | O | HOH | S | 101 | −33.501 | 29.233 | 52.200 | 1.00 | 0.00 | XXXX | 5947 |
| HETATM | 5948 | O | HOH | S | 102 | −7.270 | 41.690 | 58.853 | 1.00 | 0.00 | XXXX | 5948 |
| HETATM | 5949 | O | HOH | S | 103 | 6.680 | 43.730 | 29.933 | 1.00 | 0.00 | XXXX | 5949 |
| HETATM | 5950 | O | HOH | S | 104 | 2.247 | 32.277 | 52.847 | 1.00 | 0.00 | XXXX | 5950 |
| HETATM | 5951 | O | HOH | S | 105 | 21.928 | 53.741 | 41.984 | 1.00 | 0.00 | XXXX | 5951 |
| HETATM | 5952 | O | HOH | S | 106 | 9.472 | 37.607 | 38.230 | 1.00 | 0.00 | XXXX | 5952 |
| HETATM | 5953 | O | HOH | S | 107 | −26.666 | 43.141 | 58.529 | 1.00 | 0.00 | XXXX | 5953 |
| HETATM | 5954 | O | HOH | S | 108 | 5.623 | 30.252 | 57.256 | 1.00 | 0.00 | XXXX | 5954 |
| HETATM | 5955 | O | HOH | S | 109 | 5.630 | 50.617 | 77.198 | 1.00 | 0.00 | XXXX | 5955 |
| HETATM | 5956 | O | HOH | S | 110 | 40.143 | 36.867 | 64.197 | 1.00 | 0.00 | XXXX | 5956 |
| HETATM | 5957 | O | HOH | S | 111 | 30.891 | 28.205 | 49.686 | 1.00 | 0.00 | XXXX | 5957 |
| HETATM | 5958 | O | HOH | S | 112 | 35.617 | 41.029 | 40.469 | 1.00 | 0.00 | XXXX | 5958 |
| HETATM | 5959 | O | HOH | S | 113 | 9.860 | 30.281 | 41.160 | 1.00 | 0.00 | XXXX | 5959 |
| HETATM | 5960 | O | HOH | S | 114 | 15.025 | 53.511 | 76.383 | 1.00 | 0.00 | XXXX | 5960 |
| HETATM | 5961 | O | HOH | S | 115 | 3.368 | 63.090 | 66.028 | 1.00 | 0.00 | XXXX | 5961 |
| HETATM | 5962 | O | HOH | S | 116 | 9.352 | 58.004 | 77.905 | 1.00 | 0.00 | XXXX | 5962 |
| HETATM | 5963 | O | HOH | S | 117 | 7.817 | 56.588 | 38.641 | 1.00 | 0.00 | XXXX | 5963 |
| HETATM | 5964 | O | HOH | S | 118 | −25.957 | 36.106 | 26.475 | 1.00 | 0.00 | XXXX | 5964 |
| HETATM | 5965 | O | HOH | S | 119 | 9.855 | 43.319 | 52.016 | 1.00 | 0.00 | XXXX | 5965 |
| HETATM | 5966 | O | HOH | S | 120 | 5.054 | 67.135 | 37.718 | 1.00 | 0.00 | XXXX | 5966 |
| HETATM | 5967 | O | HOH | S | 121 | −31.338 | 48.463 | 50.394 | 1.00 | 0.00 | XXXX | 5967 |
| HETATM | 5968 | O | HOH | S | 122 | −36.127 | 49.806 | 35.354 | 1.00 | 0.00 | XXXX | 5968 |
| HETATM | 5969 | O | HOH | S | 123 | 3.346 | 64.953 | 77.083 | 1.00 | 0.00 | XXXX | 5969 |
| HETATM | 5970 | O | HOH | S | 124 | 33.011 | 40.393 | 33.311 | 1.00 | 0.00 | XXXX | 5970 |
| HETATM | 5971 | O | HOH | S | 125 | 22.444 | 61.801 | 62.628 | 1.00 | 0.00 | XXXX | 5971 |
| HETATM | 5972 | O | HOH | S | 126 | −5.619 | 30.509 | 33.293 | 1.00 | 0.00 | XXXX | 5972 |
| HETATM | 5973 | O | HOH | S | 127 | 33.470 | 29.477 | 38.857 | 1.00 | 0.00 | XXXX | 5973 |
| HETATM | 5974 | O | HOH | S | 128 | −12.066 | 38.500 | 55.690 | 1.00 | 0.00 | XXXX | 5974 |
| HETATM | 5975 | O | HOH | S | 129 | 39.613 | 42.390 | 52.293 | 1.00 | 0.00 | XXXX | 5975 |
| HETATM | 5976 | O | HOH | S | 130 | 38.817 | 31.392 | 38.021 | 1.00 | 0.00 | XXXX | 5976 |
| HETATM | 5977 | O | HOH | S | 131 | 5.909 | 39.613 | 71.255 | 1.00 | 0.00 | XXXX | 5977 |

| | | | | | | | | | | |
|---|---|---|---|---|---|---|---|---|---|---|
| HETATM | 5978 | O | HOH S | 132 | 26.773 | 56.856 | 47.633 | 1.00 | 0.00 | XXXX | 5978 |
| HETATM | 5979 | O | HOH S | 133 | 24.662 | 59.899 | 58.991 | 1.00 | 0.00 | XXXX | 5979 |
| HETATM | 5980 | O | HOH S | 134 | 43.272 | 35.673 | 58.079 | 1.00 | 0.00 | XXXX | 5980 |
| HETATM | 5981 | O | HOH S | 135 | 31.436 | 48.859 | 40.673 | 1.00 | 0.00 | XXXX | 5981 |
| HETATM | 5982 | O | HOH S | 136 | −22.067 | 59.556 | 41.107 | 1.00 | 0.00 | XXXX | 5982 |
| HETATM | 5983 | O | HOH S | 137 | 0.664 | 54.347 | 74.797 | 1.00 | 0.00 | XXXX | 5983 |
| HETATM | 5984 | O | HOH S | 138 | 38.063 | 51.588 | 69.825 | 1.00 | 0.00 | XXXX | 5984 |
| HETATM | 5985 | O | HOH S | 139 | 36.840 | 42.244 | 38.288 | 1.00 | 0.00 | XXXX | 5985 |
| HETATM | 5986 | O | HOH S | 140 | 11.016 | 41.378 | 35.589 | 1.00 | 0.00 | XXXX | 5986 |
| HETATM | 5987 | O | HOH S | 141 | 12.217 | 38.875 | 34.997 | 1.00 | 0.00 | XXXX | 5987 |
| HETATM | 5988 | O | HOH S | 142 | −10.825 | 41.131 | 55.158 | 1.00 | 0.00 | XXXX | 5988 |
| HETATM | 5989 | O | HOH S | 143 | −2.175 | 32.196 | 37.648 | 1.00 | 0.00 | XXXX | 5989 |
| HETATM | 5990 | O | HOH S | 144 | 5.628 | 61.532 | 78.210 | 1.00 | 0.00 | XXXX | 5990 |
| HETATM | 5991 | O | HOH S | 145 | −23.285 | 36.747 | 58.139 | 1.00 | 0.00 | XXXX | 5991 |
| HETATM | 5992 | O | HOH S | 146 | 27.561 | 51.781 | 39.362 | 1.00 | 0.00 | XXXX | 5992 |
| HETATM | 5993 | O | HOH S | 147 | −11.395 | 72.176 | 37.125 | 1.00 | 0.00 | XXXX | 5993 |
| HETATM | 5994 | O | HOH S | 148 | 25.356 | 44.616 | 69.482 | 1.00 | 0.00 | XXXX | 5994 |
| HETATM | 5995 | O | HOH S | 149 | −38.927 | 31.217 | 52.753 | 1.00 | 0.00 | XXXX | 5995 |
| HETATM | 5996 | O | HOH S | 150 | −3.242 | 65.528 | 14.125 | 1.00 | 0.00 | XXXX | 5996 |
| HETATM | 5997 | O | HOH S | 151 | −16.321 | 38.410 | 57.163 | 1.00 | 0.00 | XXXX | 5997 |
| HETATM | 5998 | O | HOH S | 152 | −5.689 | 64.153 | 14.372 | 1.00 | 0.00 | XXXX | 5998 |
| HETATM | 5999 | O | HOH S | 153 | −31.000 | 28.254 | 40.987 | 1.00 | 0.00 | XXXX | 5999 |
| HETATM | 6000 | O | HOH S | 154 | −7.422 | 56.293 | 52.351 | 1.00 | 0.00 | XXXX | 6000 |
| HETATM | 6001 | O | HOH S | 155 | −21.914 | 61.769 | 28.582 | 1.00 | 0.00 | XXXX | 6001 |
| HETATM | 6002 | O | HOH S | 156 | −6.873 | 51.155 | 53.070 | 1.00 | 0.00 | XXXX | 6002 |
| HETATM | 6003 | O | HOH S | 157 | 22.835 | 34.456 | 33.045 | 1.00 | 0.00 | XXXX | 6003 |
| HETATM | 6004 | O | HOH S | 158 | −6.570 | 43.711 | 60.750 | 1.00 | 0.00 | XXXX | 6004 |
| HETATM | 6005 | O | HOH S | 159 | −32.060 | 30.329 | 59.023 | 1.00 | 0.00 | XXXX | 6005 |
| HETATM | 6006 | O | HOH S | 160 | 28.569 | 39.745 | 65.505 | 1.00 | 0.00 | XXXX | 6006 |
| HETATM | 6007 | O | HOH S | 161 | 32.086 | 33.291 | 32.651 | 1.00 | 0.00 | XXXX | 6007 |
| HETATM | 6008 | O | HOH S | 162 | 12.277 | 22.808 | 44.153 | 1.00 | 0.00 | XXXX | 6008 |
| HETATM | 6009 | O | HOH S | 163 | 22.907 | 57.349 | 68.308 | 1.00 | 0.00 | XXXX | 6009 |
| HETATM | 6010 | O | HOH S | 164 | −26.733 | 47.407 | 20.389 | 1.00 | 0.00 | XXXX | 6010 |
| HETATM | 6011 | O | HOH S | 165 | −1.729 | 47.097 | 47.622 | 1.00 | 0.00 | XXXX | 6011 |
| HETATM | 6012 | O | HOH S | 166 | 35.256 | 38.804 | 33.908 | 1.00 | 0.00 | XXXX | 6012 |
| HETATM | 6013 | O | HOH S | 167 | −27.004 | 22.089 | 46.084 | 1.00 | 0.00 | XXXX | 6013 |
| HETATM | 6014 | O | HOH S | 168 | 8.626 | 61.161 | 38.570 | 1.00 | 0.00 | XXXX | 6014 |
| HETATM | 6015 | O | HOH S | 169 | −38.029 | 29.949 | 38.833 | 1.00 | 0.00 | XXXX | 6015 |
| HETATM | 6016 | O | HOH S | 170 | 10.200 | 30.505 | 65.411 | 1.00 | 0.00 | XXXX | 6016 |
| HETATM | 6017 | O | HOH S | 171 | 3.850 | 32.008 | 50.524 | 1.00 | 0.00 | XXXX | 6017 |
| HETATM | 6018 | O | HOH S | 172 | −5.416 | 65.276 | 29.312 | 1.00 | 0.00 | XXXX | 6018 |
| HETATM | 6019 | O | HOH S | 173 | −27.411 | 41.746 | 23.627 | 1.00 | 0.00 | XXXX | 6019 |
| HETATM | 6020 | O | HOH S | 174 | −6.957 | 70.289 | 22.134 | 1.00 | 0.00 | XXXX | 6020 |
| HETATM | 6021 | O | HOH S | 175 | −16.267 | 25.337 | 39.422 | 1.00 | 0.00 | XXXX | 6021 |
| HETATM | 6022 | O | HOH S | 176 | 10.025 | 27.580 | 57.945 | 1.00 | 0.00 | XXXX | 6022 |
| HETATM | 6023 | O | HOH S | 177 | 2.808 | 61.949 | 42.634 | 1.00 | 0.00 | XXXX | 6023 |
| HETATM | 6024 | O | HOH S | 178 | 35.908 | 39.396 | 69.249 | 1.00 | 0.00 | XXXX | 6024 |
| HETATM | 6025 | O | HOH S | 179 | −37.499 | 39.738 | 49.111 | 1.00 | 0.00 | XXXX | 6025 |
| HETATM | 6026 | O | HOH S | 180 | 27.562 | 41.357 | 67.265 | 1.00 | 0.00 | XXXX | 6026 |
| HETATM | 6027 | O | HOH S | 181 | −2.690 | 38.389 | 41.980 | 1.00 | 0.00 | XXXX | 6027 |
| HETATM | 6028 | O | HOH S | 182 | 19.242 | 68.254 | 58.574 | 1.00 | 0.00 | XXXX | 6028 |
| HETATM | 6029 | O | HOH S | 183 | −3.266 | 49.520 | 14.311 | 1.00 | 0.00 | XXXX | 6029 |
| HETATM | 6030 | O | HOH S | 184 | −24.553 | 41.347 | 23.501 | 1.00 | 0.00 | XXXX | 6030 |
| HETATM | 6031 | O | HOH S | 185 | −41.942 | 38.598 | 27.621 | 1.00 | 0.00 | XXXX | 6031 |
| HETATM | 6032 | O | HOH S | 186 | 13.437 | 63.904 | 40.255 | 1.00 | 0.00 | XXXX | 6032 |
| HETATM | 6033 | O | HOH S | 187 | 13.159 | 59.507 | 71.791 | 1.00 | 0.00 | XXXX | 6033 |
| HETATM | 6034 | O | HOH S | 188 | 38.006 | 29.900 | 51.954 | 1.00 | 0.00 | XXXX | 6034 |
| HETATM | 6035 | O | HOH S | 189 | 7.875 | 45.611 | 40.159 | 1.00 | 0.00 | XXXX | 6035 |
| HETATM | 6036 | O | HOH S | 190 | −5.896 | 39.780 | 45.006 | 1.00 | 0.00 | XXXX | 6036 |
| HETATM | 6037 | O | HOH S | 191 | 32.085 | 30.631 | 31.973 | 1.00 | 0.00 | XXXX | 6037 |
| HETATM | 6038 | O | HOH S | 192 | 15.135 | 35.053 | 70.933 | 1.00 | 0.00 | XXXX | 6038 |
| HETATM | 6039 | O | HOH S | 193 | −2.278 | 61.945 | 48.452 | 1.00 | 0.00 | XXXX | 6039 |
| HETATM | 6040 | O | HOH S | 194 | −23.659 | 45.746 | 61.583 | 1.00 | 0.00 | XXXX | 6040 |
| HETATM | 6041 | O | HOH S | 195 | 9.646 | 33.940 | 38.761 | 1.00 | 0.00 | XXXX | 6041 |
| HETATM | 6042 | O | HOH S | 196 | 14.503 | 43.582 | 36.956 | 1.00 | 0.00 | XXXX | 6042 |
| HETATM | 6043 | O | HOH S | 197 | −25.329 | 44.805 | 21.403 | 1.00 | 0.00 | XXXX | 6043 |
| HETATM | 6044 | O | HOH S | 198 | −14.670 | 48.499 | 67.349 | 1.00 | 0.00 | XXXX | 6044 |
| HETATM | 6045 | O | HOH S | 199 | −43.566 | 38.801 | 29.321 | 1.00 | 0.00 | XXXX | 6045 |
| HETATM | 6046 | O | HOH S | 200 | 5.815 | 54.498 | 78.890 | 1.00 | 0.00 | XXXX | 6046 |
| HETATM | 6047 | O | HOH S | 201 | 3.531 | 65.762 | 41.611 | 1.00 | 0.00 | XXXX | 6047 |
| HETATM | 6048 | O | HOH S | 202 | 23.391 | 37.516 | 32.599 | 1.00 | 0.00 | XXXX | 6048 |
| HETATM | 6049 | O | HOH S | 203 | 7.745 | 51.736 | 79.097 | 1.00 | 0.00 | XXXX | 6049 |
| HETATM | 6050 | O | HOH S | 204 | 20.986 | 47.331 | 32.755 | 1.00 | 0.00 | XXXX | 6050 |
| HETATM | 6051 | O | HOH S | 205 | 6.586 | 69.980 | 48.328 | 1.00 | 0.00 | XXXX | 6051 |
| HETATM | 6052 | O | HOH S | 206 | −35.244 | 31.640 | 55.891 | 1.00 | 0.00 | XXXX | 6052 |
| HETATM | 6053 | O | HOH S | 207 | −9.483 | 45.381 | 52.770 | 1.00 | 0.00 | XXXX | 6053 |
| HETATM | 6054 | O | HOH S | 208 | −28.373 | 45.137 | 54.641 | 1.00 | 0.00 | XXXX | 6054 |
| HETATM | 6055 | O | HOH S | 209 | 26.546 | 46.859 | 70.482 | 1.00 | 0.00 | XXXX | 6055 |
| HETATM | 6056 | O | HOH S | 210 | 36.032 | 44.776 | 38.157 | 1.00 | 0.00 | XXXX | 6056 |

-continued

| | | | | | | | | | | |
|---|---|---|---|---|---|---|---|---|---|---|
| HETATM | 6057 | O | HOH S | 211 | −16.189 | 66.748 | 40.482 | 1.00 | 0.00 | XXXX | 6057 |
| HETATM | 6058 | O | HOH S | 212 | −28.885 | 40.395 | 25.199 | 1.00 | 0.00 | XXXX | 6058 |
| HETATM | 6059 | O | HOH S | 213 | 5.531 | 63.679 | 76.449 | 1.00 | 0.00 | XXXX | 6059 |
| HETATM | 6060 | O | HOH S | 214 | 38.689 | 48.020 | 56.301 | 1.00 | 0.00 | XXXX | 6060 |
| HETATM | 6061 | O | HOH S | 215 | −17.537 | 42.717 | 15.292 | 1.00 | 0.00 | XXXX | 6061 |
| HETATM | 6062 | O | HOH S | 216 | 26.362 | 58.040 | 56.064 | 1.00 | 0.00 | XXXX | 6062 |
| HETATM | 6063 | O | HOH S | 217 | 22.273 | 59.508 | 49.958 | 1.00 | 0.00 | XXXX | 6063 |
| HETATM | 6064 | O | HOH S | 218 | −26.793 | 56.793 | 43.505 | 1.00 | 0.00 | XXXX | 6064 |
| HETATM | 6065 | O | HOH S | 219 | 43.685 | 38.572 | 61.401 | 1.00 | 0.00 | XXXX | 6065 |
| HETATM | 6066 | O | HOH S | 220 | −6.565 | 52.263 | 56.790 | 1.00 | 0.00 | XXXX | 6066 |
| HETATM | 6067 | O | HOH S | 221 | 17.518 | 42.613 | 75.403 | 1.00 | 0.00 | XXXX | 6067 |
| HETATM | 6068 | O | HOH S | 222 | −27.062 | 37.614 | 24.540 | 1.00 | 0.00 | XXXX | 6068 |
| HETATM | 6069 | O | HOH S | 223 | 21.641 | 43.990 | 73.819 | 1.00 | 0.00 | XXXX | 6069 |
| HETATM | 6070 | O | HOH S | 224 | −3.577 | 30.623 | 21.396 | 1.00 | 0.00 | XXXX | 6070 |
| HETATM | 6071 | O | HOH S | 225 | −15.145 | 53.918 | 14.458 | 1.00 | 0.00 | XXXX | 6071 |
| HETATM | 6072 | O | HOH S | 226 | 6.855 | 26.575 | 54.995 | 1.00 | 0.00 | XXXX | 6072 |
| HETATM | 6073 | O | HOH S | 227 | 33.842 | 29.441 | 34.342 | 1.00 | 0.00 | XXXX | 6073 |
| HETATM | 6074 | O | HOH S | 228 | −40.507 | 33.136 | 33.419 | 1.00 | 0.00 | XXXX | 6074 |
| HETATM | 6075 | O | HOH S | 229 | 14.086 | 42.030 | 35.081 | 1.00 | 0.00 | XXXX | 6075 |
| HETATM | 6076 | O | HOH S | 230 | −10.384 | 42.714 | 52.971 | 1.00 | 0.00 | XXXX | 6076 |
| HETATM | 6077 | O | HOH S | 231 | −28.143 | 56.857 | 41.609 | 1.00 | 0.00 | XXXX | 6077 |
| HETATM | 6078 | O | HOH S | 232 | −25.427 | 38.985 | 23.035 | 1.00 | 0.00 | XXXX | 6078 |
| HETATM | 6079 | O | HOH S | 233 | −23.376 | 55.395 | 20.918 | 1.00 | 0.00 | XXXX | 6079 |
| HETATM | 6080 | O | HOH S | 234 | −39.660 | 42.739 | 38.922 | 1.00 | 0.00 | XXXX | 6080 |
| HETATM | 6081 | O | HOH S | 235 | 3.001 | 38.373 | 48.607 | 1.00 | 0.00 | XXXX | 6081 |
| HETATM | 6082 | O | HOH S | 236 | −11.501 | 30.529 | 28.989 | 1.00 | 0.00 | XXXX | 6082 |
| HETATM | 6083 | O | HOH S | 237 | 9.592 | 42.593 | 33.323 | 1.00 | 0.00 | XXXX | 6083 |
| HETATM | 6084 | O | HOH S | 238 | 23.473 | 50.969 | 71.802 | 1.00 | 0.00 | XXXX | 6084 |
| HETATM | 6085 | O | HOH S | 239 | 6.860 | 52.951 | 21.240 | 1.00 | 0.00 | XXXX | 6085 |
| HETATM | 6086 | O | HOH S | 240 | −21.915 | 44.465 | 17.216 | 1.00 | 0.00 | XXXX | 6086 |
| HETATM | 6087 | O | HOH S | 241 | −3.574 | 31.769 | 40.172 | 1.00 | 0.00 | XXXX | 6087 |
| HETATM | 6088 | O | HOH S | 242 | 19.204 | 69.680 | 62.340 | 1.00 | 0.00 | XXXX | 6088 |
| HETATM | 6089 | O | HOH S | 243 | 42.035 | 39.869 | 56.540 | 1.00 | 0.00 | XXXX | 6089 |
| HETATM | 6090 | O | HOH S | 244 | 2.607 | 47.698 | 42.767 | 1.00 | 0.00 | XXXX | 6090 |
| HETATM | 6091 | O | HOH S | 245 | −8.957 | 24.390 | 39.598 | 1.00 | 0.00 | XXXX | 6091 |
| HETATM | 6092 | O | HOH S | 246 | −19.564 | 61.419 | 41.906 | 1.00 | 0.00 | XXXX | 6092 |
| HETATM | 6093 | O | HOH S | 247 | 12.245 | 31.885 | 66.604 | 1.00 | 0.00 | XXXX | 6093 |
| HETATM | 6094 | O | HOH S | 248 | −23.266 | 28.825 | 40.383 | 1.00 | 0.00 | XXXX | 6094 |
| HETATM | 6095 | O | HOH S | 249 | 16.525 | 66.480 | 50.658 | 1.00 | 0.00 | XXXX | 6095 |
| HETATM | 6096 | O | HOH S | 250 | −3.935 | 66.710 | 49.250 | 1.00 | 0.00 | XXXX | 6096 |
| HETATM | 6097 | O | HOH S | 251 | −0.835 | 68.172 | 25.966 | 1.00 | 0.00 | XXXX | 6097 |
| HETATM | 6098 | O | HOH S | 252 | −11.398 | 66.340 | 18.295 | 1.00 | 0.00 | XXXX | 6098 |
| HETATM | 6099 | O | HOH S | 253 | −28.668 | 32.295 | 25.475 | 1.00 | 0.00 | XXXX | 6099 |
| HETATM | 6100 | O | HOH S | 254 | −26.530 | 34.486 | 59.354 | 1.00 | 0.00 | XXXX | 6100 |
| HETATM | 6101 | O | HOH S | 255 | 4.371 | 69.174 | 66.368 | 1.00 | 0.00 | XXXX | 6101 |
| HETATM | 6102 | O | HOH S | 256 | 38.078 | 38.304 | 65.536 | 1.00 | 0.00 | XXXX | 6102 |
| HETATM | 6103 | O | HOH S | 257 | −11.276 | 35.937 | 21.160 | 1.00 | 0.00 | XXXX | 6103 |
| HETATM | 6104 | O | HOH S | 258 | −24.139 | 47.491 | 19.350 | 1.00 | 0.00 | XXXX | 6104 |
| HETATM | 6105 | O | HOH S | 259 | −22.304 | 35.606 | 18.727 | 1.00 | 0.00 | XXXX | 6105 |
| HETATM | 6106 | O | HOH S | 260 | 6.403 | 40.060 | 45.344 | 1.00 | 0.00 | XXXX | 6106 |
| HETATM | 6107 | O | HOH S | 261 | 8.398 | 49.044 | 37.424 | 1.00 | 0.00 | XXXX | 6107 |
| HETATM | 6108 | O | HOH S | 262 | −21.523 | 65.918 | 26.334 | 1.00 | 0.00 | XXXX | 6108 |
| HETATM | 6109 | O | HOH S | 263 | −23.122 | 57.551 | 22.614 | 1.00 | 0.00 | XXXX | 6109 |
| HETATM | 6110 | O | HOH S | 264 | 28.570 | 32.147 | 64.954 | 1.00 | 0.00 | XXXX | 6110 |
| HETATM | 6111 | O | HOH S | 265 | −30.754 | 44.243 | 54.051 | 1.00 | 0.00 | XXXX | 6111 |
| HETATM | 6112 | O | HOH S | 266 | 19.822 | 47.217 | 77.280 | 1.00 | 0.00 | XXXX | 6112 |
| HETATM | 6113 | O | HOH S | 267 | 9.536 | 45.774 | 38.013 | 1.00 | 0.00 | XXXX | 6113 |
| HETATM | 6114 | O | HOH S | 268 | −13.104 | 64.011 | 50.838 | 1.00 | 0.00 | XXXX | 6114 |
| HETATM | 6115 | O | HOH S | 269 | 41.565 | 49.185 | 71.432 | 1.00 | 0.00 | XXXX | 6115 |
| HETATM | 6116 | O | HOH S | 270 | 11.846 | 31.549 | 63.410 | 1.00 | 0.00 | XXXX | 6116 |
| HETATM | 6117 | O | HOH S | 271 | −10.354 | 30.778 | 25.234 | 1.00 | 0.00 | XXXX | 6117 |
| HETATM | 6118 | O | HOH S | 272 | 4.516 | 35.523 | 43.014 | 1.00 | 0.00 | XXXX | 6118 |
| HETATM | 6119 | O | HOH S | 273 | −4.729 | 38.677 | 47.116 | 1.00 | 0.00 | XXXX | 6119 |
| HETATM | 6120 | O | HOH S | 274 | 14.888 | 39.456 | 35.003 | 1.00 | 0.00 | XXXX | 6120 |
| HETATM | 6121 | O | HOH S | 275 | −2.078 | 32.445 | 58.660 | 1.00 | 0.00 | XXXX | 6121 |
| HETATM | 6122 | O | HOH S | 276 | 20.563 | 22.789 | 59.030 | 1.00 | 0.00 | XXXX | 6122 |
| HETATM | 6123 | O | HOH S | 277 | 20.934 | 63.940 | 61.759 | 1.00 | 0.00 | XXXX | 6123 |
| HETATM | 6124 | O | HOH S | 278 | −7.929 | 45.181 | 38.901 | 1.00 | 0.00 | XXXX | 6124 |
| HETATM | 6125 | O | HOH S | 279 | −3.725 | 60.475 | 76.271 | 1.00 | 0.00 | XXXX | 6125 |
| HETATM | 6126 | O | HOH S | 280 | −2.033 | 46.374 | 17.317 | 1.00 | 0.00 | XXXX | 6126 |
| HETATM | 6127 | O | HOH S | 281 | 4.318 | 60.597 | 15.113 | 1.00 | 0.00 | XXXX | 6127 |
| HETATM | 6128 | O | HOH S | 282 | 34.674 | 50.553 | 51.257 | 1.00 | 0.00 | XXXX | 6128 |
| HETATM | 6129 | O | HOH S | 283 | −23.984 | 55.757 | 18.609 | 1.00 | 0.00 | XXXX | 6129 |
| HETATM | 6130 | O | HOH S | 284 | −7.297 | 52.459 | 69.524 | 1.00 | 0.00 | XXXX | 6130 |
| HETATM | 6131 | O | HOH S | 285 | −31.470 | 55.132 | 39.573 | 1.00 | 0.00 | XXXX | 6131 |
| HETATM | 6132 | O | HOH S | 286 | −36.131 | 27.278 | 35.041 | 1.00 | 0.00 | XXXX | 6132 |
| HETATM | 6133 | O | HOH S | 287 | −6.437 | 46.459 | 59.392 | 1.00 | 0.00 | XXXX | 6133 |
| HETATM | 6134 | O | HOH S | 288 | −32.003 | 32.879 | 58.472 | 1.00 | 0.00 | XXXX | 6134 |
| HETATM | 6135 | O | HOH S | 289 | −19.329 | 54.096 | 51.947 | 1.00 | 0.00 | XXXX | 6135 |

| | | | | | | | | | | |
|---|---|---|---|---|---|---|---|---|---|---|
| HETATM | 6136 | O | HOH S | 290 | −12.806 | 44.654 | 17.113 | 1.00 | 0.00 | XXXX | 6136 |
| HETATM | 6137 | O | HOH S | 291 | 39.474 | 48.489 | 58.884 | 1.00 | 0.00 | XXXX | 6137 |
| HETATM | 6138 | O | HOH S | 292 | 3.261 | 49.135 | 76.659 | 1.00 | 0.00 | XXXX | 6138 |
| HETATM | 6139 | O | HOH S | 293 | −6.690 | 26.859 | 35.573 | 1.00 | 0.00 | XXXX | 6139 |
| HETATM | 6140 | O | HOH S | 294 | 24.317 | 46.253 | 29.348 | 1.00 | 0.00 | XXXX | 6140 |
| HETATM | 6141 | O | HOH S | 295 | 2.725 | 31.354 | 57.741 | 1.00 | 0.00 | XXXX | 6141 |
| HETATM | 6142 | O | HOH S | 296 | −9.603 | 42.155 | 57.320 | 1.00 | 0.00 | XXXX | 6142 |
| HETATM | 6143 | O | HOH S | 297 | 2.755 | 68.633 | 60.118 | 1.00 | 0.00 | XXXX | 6143 |
| HETATM | 6144 | O | HOH S | 298 | −5.771 | 50.383 | 69.099 | 1.00 | 0.00 | XXXX | 6144 |
| HETATM | 6145 | O | HOH S | 299 | 36.244 | 37.722 | 67.565 | 1.00 | 0.00 | XXXX | 6145 |
| HETATM | 6146 | O | HOH S | 300 | 35.377 | 31.833 | 34.686 | 1.00 | 0.00 | XXXX | 6146 |
| HETATM | 6147 | O | HOH S | 301 | 16.695 | 39.121 | 33.599 | 1.00 | 0.00 | XXXX | 6147 |
| HETATM | 6148 | O | HOH S | 302 | 33.108 | 39.647 | 66.961 | 1.00 | 0.00 | XXXX | 6148 |
| HETATM | 6149 | O | HOH S | 303 | −30.848 | 29.785 | 49.974 | 1.00 | 0.00 | XXXX | 6149 |
| HETATM | 6150 | O | HOH S | 304 | 6.087 | 34.715 | 33.188 | 1.00 | 0.00 | XXXX | 6150 |
| HETATM | 6151 | O | HOH S | 305 | −13.093 | 60.123 | 19.102 | 1.00 | 0.00 | XXXX | 6151 |
| HETATM | 6152 | O | HOH S | 306 | −26.156 | 45.622 | 57.634 | 1.00 | 0.00 | XXXX | 6152 |
| HETATM | 6153 | O | HOH S | 307 | 24.100 | 46.925 | 71.508 | 1.00 | 0.00 | XXXX | 6153 |
| HETATM | 6154 | O | HOH S | 308 | −37.745 | 43.324 | 45.347 | 1.00 | 0.00 | XXXX | 6154 |
| HETATM | 6155 | O | HOH S | 309 | −3.996 | 66.349 | 61.185 | 1.00 | 0.00 | XXXX | 6155 |
| HETATM | 6156 | O | HOH S | 310 | −21.554 | 58.037 | 45.356 | 1.00 | 0.00 | XXXX | 6156 |
| HETATM | 6157 | O | HOH S | 311 | 11.342 | 65.909 | 72.718 | 1.00 | 0.00 | XXXX | 6157 |
| HETATM | 6158 | O | HOH S | 312 | 32.387 | 28.532 | 36.678 | 1.00 | 0.00 | XXXX | 6158 |
| HETATM | 6159 | O | HOH S | 313 | −5.923 | 49.633 | 51.789 | 1.00 | 0.00 | XXXX | 6159 |
| HETATM | 6160 | O | HOH S | 314 | 6.098 | 49.559 | 39.266 | 1.00 | 0.00 | XXXX | 6160 |
| HETATM | 6161 | O | HOH S | 315 | −9.672 | 57.207 | 71.148 | 1.00 | 0.00 | XXXX | 6161 |
| HETATM | 6162 | O | HOH S | 316 | 7.722 | 43.483 | 41.215 | 1.00 | 0.00 | XXXX | 6162 |
| HETATM | 6163 | O | HOH S | 317 | −19.956 | 25.576 | 45.832 | 1.00 | 0.00 | XXXX | 6163 |
| HETATM | 6164 | O | HOH S | 318 | 6.686 | 70.061 | 69.009 | 1.00 | 0.00 | XXXX | 6164 |
| HETATM | 6165 | O | HOH S | 319 | −20.203 | 34.493 | 59.056 | 1.00 | 0.00 | XXXX | 6165 |
| HETATM | 6166 | O | HOH S | 320 | 2.670 | 67.324 | 21.006 | 1.00 | 0.00 | XXXX | 6166 |
| HETATM | 6167 | O | HOH S | 321 | −21.077 | 26.567 | 38.602 | 1.00 | 0.00 | XXXX | 6167 |
| HETATM | 6168 | O | HOH S | 322 | 37.343 | 44.770 | 43.285 | 1.00 | 0.00 | XXXX | 6168 |
| HETATM | 6169 | O | HOH S | 323 | 22.290 | 34.976 | 71.909 | 1.00 | 0.00 | XXXX | 6169 |
| HETATM | 6170 | O | HOH S | 324 | −33.383 | 27.458 | 38.895 | 1.00 | 0.00 | XXXX | 6170 |
| HETATM | 6171 | O | HOH S | 325 | 26.215 | 36.063 | 64.141 | 1.00 | 0.00 | XXXX | 6171 |
| HETATM | 6172 | O | HOH S | 326 | −38.244 | 45.395 | 21.480 | 1.00 | 0.00 | XXXX | 6172 |
| HETATM | 6173 | O | HOH S | 327 | −33.823 | 29.410 | 56.485 | 1.00 | 0.00 | XXXX | 6173 |
| HETATM | 6174 | O | HOH S | 328 | 0.111 | 40.290 | 23.975 | 1.00 | 0.00 | XXXX | 6174 |
| HETATM | 6175 | O | HOH S | 329 | 33.065 | 51.099 | 48.143 | 1.00 | 0.00 | XXXX | 6175 |
| HETATM | 6176 | O | HOH S | 330 | 27.418 | 56.317 | 44.578 | 1.00 | 0.00 | XXXX | 6176 |
| HETATM | 6177 | O | HOH S | 331 | −23.559 | 32.319 | 59.706 | 1.00 | 0.00 | XXXX | 6177 |
| HETATM | 6178 | O | HOH S | 332 | 6.944 | 52.861 | 58.112 | 1.00 | 0.00 | XXXX | 6178 |
| HETATM | 6179 | O | HOH S | 333 | 30.625 | 44.460 | 36.827 | 1.00 | 0.00 | XXXX | 6179 |
| HETATM | 6180 | O | HOH S | 334 | −7.843 | 45.731 | 50.678 | 1.00 | 0.00 | XXXX | 6180 |
| HETATM | 6181 | O | HOH S | 335 | 19.793 | 54.330 | 38.932 | 1.00 | 0.00 | XXXX | 6181 |
| HETATM | 6182 | O | HOH S | 336 | −8.645 | 61.062 | 52.625 | 1.00 | 0.00 | XXXX | 6182 |
| HETATM | 6183 | O | HOH S | 337 | −41.146 | 49.175 | 19.163 | 1.00 | 0.00 | XXXX | 6183 |
| HETATM | 6184 | O | HOH S | 338 | −34.177 | 42.368 | 58.283 | 1.00 | 0.00 | XXXX | 6184 |
| HETATM | 6185 | O | HOH S | 339 | −38.777 | 44.807 | 40.693 | 1.00 | 0.00 | XXXX | 6185 |
| HETATM | 6186 | O | HOH S | 340 | 37.385 | 45.609 | 47.079 | 1.00 | 0.00 | XXXX | 6186 |
| HETATM | 6187 | O | HOH S | 341 | 18.577 | 60.321 | 68.890 | 1.00 | 0.00 | XXXX | 6187 |
| HETATM | 6188 | O | HOH S | 342 | −7.847 | 35.211 | 53.749 | 1.00 | 0.00 | XXXX | 6188 |
| HETATM | 6189 | O | HOH S | 343 | −27.302 | 52.189 | 54.314 | 1.00 | 0.00 | XXXX | 6189 |
| HETATM | 6190 | O | HOH S | 344 | −32.140 | 28.645 | 26.344 | 1.00 | 0.00 | XXXX | 6190 |
| HETATM | 6191 | O | HOH S | 345 | −1.867 | 32.514 | 42.154 | 1.00 | 0.00 | XXXX | 6191 |
| HETATM | 6192 | O | HOH S | 346 | −4.473 | 69.524 | 24.592 | 1.00 | 0.00 | XXXX | 6192 |
| HETATM | 6193 | O | HOH S | 347 | 7.093 | 66.946 | 26.396 | 1.00 | 0.00 | XXXX | 6193 |
| HETATM | 6194 | O | HOH S | 348 | −28.714 | 26.214 | 37.983 | 1.00 | 0.00 | XXXX | 6194 |
| HETATM | 6195 | O | HOH S | 349 | −14.762 | 31.939 | 56.657 | 1.00 | 0.00 | XXXX | 6195 |
| HETATM | 6196 | O | HOH S | 350 | −2.794 | 66.337 | 69.987 | 1.00 | 0.00 | XXXX | 6196 |
| HETATM | 6197 | O | HOH S | 351 | −37.211 | 45.652 | 43.618 | 1.00 | 0.00 | XXXX | 6197 |
| HETATM | 6198 | O | HOH S | 352 | 9.100 | 24.724 | 50.684 | 1.00 | 0.00 | XXXX | 6198 |
| HETATM | 6199 | O | HOH S | 353 | −9.561 | 57.774 | 55.842 | 1.00 | 0.00 | XXXX | 6199 |
| HETATM | 6200 | O | HOH S | 354 | −9.876 | 62.383 | 10.673 | 1.00 | 0.00 | XXXX | 6200 |
| HETATM | 6201 | O | HOH S | 355 | −20.103 | 47.660 | 13.611 | 1.00 | 0.00 | XXXX | 6201 |
| HETATM | 6202 | O | HOH S | 356 | 3.387 | 31.873 | 60.372 | 1.00 | 0.00 | XXXX | 6202 |
| HETATM | 6203 | O | HOH S | 357 | 22.030 | 50.920 | 34.917 | 1.00 | 0.00 | XXXX | 6203 |
| HETATM | 6204 | O | HOH S | 358 | −19.209 | 51.656 | 54.927 | 1.00 | 0.00 | XXXX | 6204 |
| HETATM | 6205 | O | HOH S | 359 | 0.499 | 30.783 | 33.133 | 1.00 | 0.00 | XXXX | 6205 |
| HETATM | 6206 | O | HOH S | 360 | −39.370 | 31.697 | 31.386 | 1.00 | 0.00 | XXXX | 6206 |
| HETATM | 6207 | O | HOH S | 361 | 5.117 | 62.172 | 41.308 | 1.00 | 0.00 | XXXX | 6207 |
| HETATM | 6208 | O | HOH S | 362 | −12.901 | 64.435 | 16.832 | 1.00 | 0.00 | XXXX | 6208 |
| HETATM | 6209 | O | HOH S | 363 | 7.426 | 27.841 | 62.038 | 1.00 | 0.00 | XXXX | 6209 |
| HETATM | 6210 | O | HOH S | 364 | 17.459 | 19.522 | 61.126 | 1.00 | 0.00 | XXXX | 6210 |
| HETATM | 6211 | O | HOH S | 365 | −39.602 | 48.819 | 32.332 | 1.00 | 0.00 | XXXX | 6211 |
| HETATM | 6212 | O | HOH S | 366 | −38.847 | 43.709 | 36.476 | 1.00 | 0.00 | XXXX | 6212 |
| HETATM | 6213 | O | HOH S | 367 | 8.827 | 54.531 | 36.659 | 1.00 | 0.00 | XXXX | 6213 |
| HETATM | 6214 | O | HOH S | 368 | 37.874 | 43.258 | 45.778 | 1.00 | 0.00 | XXXX | 6214 |

-continued

| | | | | | | | | | | |
|---|---|---|---|---|---|---|---|---|---|---|
| HETATM | 6215 | O | HOH S | 369 | 16.712 | 66.501 | 70.161 | 1.00 | 0.00 | XXXX | 6215 |
| HETATM | 6216 | O | HOH S | 370 | 39.089 | 31.143 | 59.397 | 1.00 | 0.00 | XXXX | 6216 |
| HETATM | 6217 | O | HOH S | 371 | −4.609 | 35.442 | 47.602 | 1.00 | 0.00 | XXXX | 6217 |
| HETATM | 6218 | O | HOH S | 372 | 24.068 | 32.914 | 31.102 | 1.00 | 0.00 | XXXX | 6218 |
| HETATM | 6219 | O | HOH S | 373 | −10.884 | 60.067 | 11.576 | 1.00 | 0.00 | XXXX | 6219 |
| HETATM | 6220 | O | HOH S | 374 | 14.009 | 43.394 | 75.463 | 1.00 | 0.00 | XXXX | 6220 |
| HETATM | 6221 | O | HOH S | 375 | −7.477 | 43.627 | 49.496 | 1.00 | 0.00 | XXXX | 6221 |
| HETATM | 6222 | O | HOH S | 376 | 25.160 | 38.222 | 67.973 | 1.00 | 0.00 | XXXX | 6222 |
| HETATM | 6223 | O | HOH S | 377 | −32.382 | 29.783 | 48.554 | 1.00 | 0.00 | XXXX | 6223 |
| HETATM | 6224 | O | HOH S | 378 | −38.008 | 31.329 | 55.401 | 1.00 | 0.00 | XXXX | 6224 |
| HETATM | 6225 | O | HOH S | 379 | −39.702 | 42.449 | 44.281 | 1.00 | 0.00 | XXXX | 6225 |
| HETATM | 6226 | O | HOH S | 380 | −10.463 | 27.666 | 32.788 | 1.00 | 0.00 | XXXX | 6226 |
| HETATM | 6227 | O | HOH S | 381 | 15.362 | 62.794 | 72.976 | 1.00 | 0.00 | XXXX | 6227 |
| HETATM | 6228 | O | HOH S | 382 | −16.784 | 54.371 | 53.080 | 1.00 | 0.00 | XXXX | 6228 |
| HETATM | 6229 | O | HOH S | 383 | −10.679 | 26.903 | 46.365 | 1.00 | 0.00 | XXXX | 6229 |
| HETATM | 6230 | O | HOH S | 384 | 2.327 | 42.399 | 47.564 | 1.00 | 0.00 | XXXX | 6230 |
| HETATM | 6231 | O | HOH S | 385 | −14.592 | 39.364 | 55.829 | 1.00 | 0.00 | XXXX | 6231 |
| HETATM | 6232 | O | HOH S | 386 | −0.292 | 70.387 | 18.484 | 1.00 | 0.00 | XXXX | 6232 |
| HETATM | 6233 | O | HOH S | 387 | −6.386 | 66.899 | 64.643 | 1.00 | 0.00 | XXXX | 6233 |
| HETATM | 6234 | O | HOH S | 388 | −32.870 | 52.321 | 43.132 | 1.00 | 0.00 | XXXX | 6234 |
| HETATM | 6235 | O | HOH S | 389 | −8.242 | 54.424 | 54.090 | 1.00 | 0.00 | XXXX | 6235 |
| HETATM | 6236 | O | HOH S | 390 | 17.878 | 23.926 | 49.733 | 1.00 | 0.00 | XXXX | 6236 |
| HETATM | 6237 | O | HOH S | 391 | 9.460 | 62.534 | 80.829 | 1.00 | 0.00 | XXXX | 6237 |
| HETATM | 6238 | O | HOH S | 392 | 39.827 | 46.283 | 54.598 | 1.00 | 0.00 | XXXX | 6238 |
| HETATM | 6239 | O | HOH S | 393 | 19.234 | 66.751 | 69.837 | 1.00 | 0.00 | XXXX | 6239 |
| HETATM | 6240 | O | HOH S | 394 | −4.291 | 46.002 | 47.331 | 1.00 | 0.00 | XXXX | 6240 |
| HETATM | 6241 | O | HOH S | 395 | −11.891 | 28.022 | 29.272 | 1.00 | 0.00 | XXXX | 6241 |
| HETATM | 6242 | O | HOH S | 396 | 14.520 | 42.767 | 32.549 | 1.00 | 0.00 | XXXX | 6242 |
| HETATM | 6243 | O | HOH S | 397 | −32.501 | 28.433 | 54.681 | 1.00 | 0.00 | XXXX | 6243 |
| HETATM | 6244 | O | HOH S | 398 | 23.957 | 27.826 | 62.993 | 1.00 | 0.00 | XXXX | 6244 |
| HETATM | 6245 | O | HOH S | 399 | −11.326 | 49.217 | 53.239 | 1.00 | 0.00 | XXXX | 6245 |
| HETATM | 6246 | O | HOH S | 400 | −5.967 | 34.531 | 57.340 | 1.00 | 0.00 | XXXX | 6246 |
| HETATM | 6247 | O | HOH S | 401 | 16.917 | 28.735 | 65.366 | 1.00 | 0.00 | XXXX | 6247 |
| HETATM | 6248 | O | HOH S | 402 | −7.887 | 48.303 | 52.181 | 1.00 | 0.00 | XXXX | 6248 |
| HETATM | 6249 | O | HOH S | 403 | 22.220 | 53.573 | 77.611 | 1.00 | 0.00 | XXXX | 6249 |
| HETATM | 6250 | O | HOH S | 404 | 4.679 | 71.760 | 49.504 | 1.00 | 0.00 | XXXX | 6250 |
| HETATM | 6251 | O | HOH S | 405 | −41.409 | 31.428 | 35.131 | 1.00 | 0.00 | XXXX | 6251 |
| HETATM | 6252 | O | HOH S | 406 | 22.888 | 24.260 | 49.853 | 1.00 | 0.00 | XXXX | 6252 |
| HETATM | 6253 | O | HOH S | 407 | −17.344 | 27.953 | 55.427 | 1.00 | 0.00 | XXXX | 6253 |
| HETATM | 6254 | O | HOH S | 408 | −27.958 | 33.550 | 57.565 | 1.00 | 0.00 | XXXX | 6254 |
| HETATM | 6255 | O | HOH S | 409 | 3.951 | 25.397 | 51.395 | 1.00 | 0.00 | XXXX | 6255 |
| HETATM | 6256 | O | HOH S | 410 | 33.657 | 52.256 | 43.298 | 1.00 | 0.00 | XXXX | 6256 |
| HETATM | 6257 | O | HOH S | 411 | −42.052 | 40.142 | 34.104 | 1.00 | 0.00 | XXXX | 6257 |
| HETATM | 6258 | O | HOH S | 412 | −39.716 | 46.500 | 36.315 | 1.00 | 0.00 | XXXX | 6258 |
| HETATM | 6259 | O | HOH S | 413 | 6.282 | 24.794 | 46.903 | 1.00 | 0.00 | XXXX | 6259 |
| HETATM | 6260 | O | HOH S | 414 | 4.245 | 43.954 | 43.687 | 1.00 | 0.00 | XXXX | 6260 |
| HETATM | 6261 | O | HOH S | 415 | 18.203 | 71.493 | 60.862 | 1.00 | 0.00 | XXXX | 6261 |
| HETATM | 6262 | O | HOH S | 416 | 24.278 | 21.883 | 42.563 | 1.00 | 0.00 | XXXX | 6262 |
| HETATM | 6263 | O | HOH S | 417 | 26.553 | 46.195 | 32.789 | 1.00 | 0.00 | XXXX | 6263 |
| HETATM | 6264 | O | HOH S | 418 | 40.498 | 33.031 | 58.215 | 1.00 | 0.00 | XXXX | 6264 |
| HETATM | 6265 | O | HOH S | 419 | −7.612 | 58.851 | 53.870 | 1.00 | 0.00 | XXXX | 6265 |
| HETATM | 6266 | O | HOH S | 420 | −5.108 | 66.432 | 53.148 | 1.00 | 0.00 | XXXX | 6266 |
| HETATM | 6267 | O | HOH S | 421 | 12.433 | 25.133 | 43.281 | 1.00 | 0.00 | XXXX | 6267 |
| HETATM | 6268 | O | HOH S | 422 | 6.281 | 60.567 | 39.414 | 1.00 | 0.00 | XXXX | 6268 |
| HETATM | 6269 | O | HOH S | 423 | −3.346 | 31.853 | 30.331 | 1.00 | 0.00 | XXXX | 6269 |
| HETATM | 6270 | O | HOH S | 424 | −33.061 | 26.183 | 36.379 | 1.00 | 0.00 | XXXX | 6270 |
| HETATM | 6271 | O | HOH S | 425 | −6.877 | 28.307 | 28.596 | 1.00 | 0.00 | XXXX | 6271 |
| HETATM | 6272 | O | HOH S | 426 | 6.140 | 42.489 | 42.465 | 1.00 | 0.00 | XXXX | 6272 |
| HETATM | 6273 | O | HOH S | 427 | 3.477 | 68.555 | 31.558 | 1.00 | 0.00 | XXXX | 6273 |
| HETATM | 6274 | O | HOH S | 428 | −3.532 | 68.479 | 60.026 | 1.00 | 0.00 | XXXX | 6274 |
| HETATM | 6275 | O | HOH S | 429 | 12.584 | 44.823 | 73.921 | 1.00 | 0.00 | XXXX | 6275 |
| HETATM | 6276 | O | HOH S | 430 | −15.036 | 26.121 | 47.340 | 1.00 | 0.00 | XXXX | 6276 |
| HETATM | 6277 | O | HOH S | 431 | −1.036 | 32.294 | 61.138 | 1.00 | 0.00 | XXXX | 6277 |
| HETATM | 6278 | O | HOH S | 432 | −32.481 | 51.389 | 40.859 | 1.00 | 0.00 | XXXX | 6278 |
| HETATM | 6279 | O | HOH S | 433 | 7.856 | 35.153 | 37.348 | 1.00 | 0.00 | XXXX | 6279 |
| HETATM | 6280 | O | HOH S | 434 | −8.917 | 49.606 | 53.652 | 1.00 | 0.00 | XXXX | 6280 |
| HETATM | 6281 | O | HOH S | 435 | 6.440 | 69.929 | 64.905 | 1.00 | 0.00 | XXXX | 6281 |
| HETATM | 6282 | O | HOH S | 436 | −24.797 | 61.937 | 35.334 | 1.00 | 0.00 | XXXX | 6282 |
| HETATM | 6283 | O | HOH S | 437 | −12.775 | 31.809 | 23.996 | 1.00 | 0.00 | XXXX | 6283 |
| HETATM | 6284 | O | HOH S | 438 | −38.516 | 47.694 | 34.475 | 1.00 | 0.00 | XXXX | 6284 |
| HETATM | 6285 | O | HOH S | 439 | 32.325 | 51.235 | 50.196 | 1.00 | 0.00 | XXXX | 6285 |
| HETATM | 6286 | O | HOH S | 440 | 4.808 | 46.190 | 43.479 | 1.00 | 0.00 | XXXX | 6286 |
| HETATM | 6287 | O | HOH S | 441 | −15.244 | 64.045 | 18.186 | 1.00 | 0.00 | XXXX | 6287 |
| HETATM | 6288 | O | HOH S | 442 | 20.398 | 34.676 | 31.613 | 1.00 | 0.00 | XXXX | 6288 |
| HETATM | 6289 | O | HOH S | 443 | 8.793 | 40.673 | 29.467 | 1.00 | 0.00 | XXXX | 6289 |
| HETATM | 6290 | O | HOH S | 444 | −29.527 | 55.652 | 38.746 | 1.00 | 0.00 | XXXX | 6290 |
| HETATM | 6291 | O | HOH S | 445 | −24.023 | 28.373 | 27.729 | 1.00 | 0.00 | XXXX | 6291 |
| HETATM | 6292 | O | HOH S | 446 | 42.935 | 39.988 | 58.492 | 1.00 | 0.00 | XXXX | 6292 |
| HETATM | 6293 | O | HOH S | 447 | −9.266 | 72.698 | 44.657 | 1.00 | 0.00 | XXXX | 6293 |

| | | | | | | | | | | |
|---|---|---|---|---|---|---|---|---|---|---|
| HETATM | 6294 | O | HOH S | 448 | −21.513 | 39.561 | 60.161 | 1.00 | 0.00 | XXXX | 6294 |
| HETATM | 6295 | O | HOH S | 449 | −12.922 | 68.192 | 18.762 | 1.00 | 0.00 | XXXX | 6295 |
| HETATM | 6296 | O | HOH S | 450 | 39.468 | 42.826 | 46.760 | 1.00 | 0.00 | XXXX | 6296 |
| HETATM | 6297 | O | HOH S | 451 | −12.470 | 22.430 | 46.399 | 1.00 | 0.00 | XXXX | 6297 |
| HETATM | 6298 | O | HOH S | 452 | 41.160 | 45.055 | 62.904 | 1.00 | 0.00 | XXXX | 6298 |
| HETATM | 6299 | O | HOH S | 453 | 17.795 | 52.319 | 76.335 | 1.00 | 0.00 | XXXX | 6299 |
| HETATM | 6300 | O | HOH S | 454 | 5.493 | 73.426 | 50.497 | 1.00 | 0.00 | XXXX | 6300 |
| HETATM | 6301 | O | HOH S | 455 | −24.373 | 27.684 | 38.287 | 1.00 | 0.00 | XXXX | 6301 |
| HETATM | 6302 | O | HOH S | 456 | −17.345 | 36.981 | 59.108 | 1.00 | 0.00 | XXXX | 6302 |
| HETATM | 6303 | O | HOH S | 457 | 16.992 | 25.106 | 61.890 | 1.00 | 0.00 | XXXX | 6303 |
| HETATM | 6304 | O | HOH S | 458 | −19.206 | 69.119 | 32.478 | 1.00 | 0.00 | XXXX | 6304 |
| HETATM | 6305 | O | HOH S | 459 | −25.184 | 47.093 | 59.509 | 1.00 | 0.00 | XXXX | 6305 |
| HETATM | 6306 | O | HOH S | 460 | −31.434 | 56.150 | 26.862 | 1.00 | 0.00 | XXXX | 6306 |
| HETATM | 6307 | O | HOH S | 461 | −13.131 | 57.112 | 69.718 | 1.00 | 0.00 | XXXX | 6307 |
| HETATM | 6308 | O | HOH S | 462 | 16.785 | 68.977 | 70.514 | 1.00 | 0.00 | XXXX | 6308 |
| HETATM | 6309 | O | HOH S | 463 | 39.188 | 46.172 | 60.968 | 1.00 | 0.00 | XXXX | 6309 |
| HETATM | 6310 | O | HOH S | 464 | 16.879 | 21.684 | 43.758 | 1.00 | 0.00 | XXXX | 6310 |
| HETATM | 6311 | O | HOH S | 465 | −7.146 | 66.474 | 13.771 | 1.00 | 0.00 | XXXX | 6311 |
| HETATM | 6312 | O | HOH S | 466 | 7.047 | 65.757 | 77.271 | 1.00 | 0.00 | XXXX | 6312 |
| HETATM | 6313 | O | HOH S | 467 | 22.485 | 33.288 | 69.996 | 1.00 | 0.00 | XXXX | 6313 |
| HETATM | 6314 | O | HOH S | 468 | −42.948 | 40.184 | 31.889 | 1.00 | 0.00 | XXXX | 6314 |
| HETATM | 6315 | O | HOH S | 469 | 16.138 | 25.020 | 51.311 | 1.00 | 0.00 | XXXX | 6315 |
| HETATM | 6316 | O | HOH S | 470 | −10.976 | 60.411 | 52.560 | 1.00 | 0.00 | XXXX | 6316 |
| HETATM | 6317 | O | HOH S | 471 | −18.188 | 60.790 | 22.098 | 1.00 | 0.00 | XXXX | 6317 |
| HETATM | 6318 | O | HOH S | 472 | 10.456 | 26.760 | 44.189 | 1.00 | 0.00 | XXXX | 6318 |
| HETATM | 6319 | O | HOH S | 473 | −0.346 | 66.737 | 76.934 | 1.00 | 0.00 | XXXX | 6319 |
| HETATM | 6320 | O | HOH S | 474 | −17.800 | 27.755 | 46.757 | 1.00 | 0.00 | XXXX | 6320 |
| HETATM | 6321 | O | HOH S | 475 | −3.665 | 30.874 | 28.475 | 1.00 | 0.00 | XXXX | 6321 |
| HETATM | 6322 | O | HOH S | 476 | −9.220 | 34.141 | 52.047 | 1.00 | 0.00 | XXXX | 6322 |
| HETATM | 6323 | O | HOH S | 477 | 24.051 | 54.557 | 72.324 | 1.00 | 0.00 | XXXX | 6323 |
| HETATM | 6324 | O | HOH S | 478 | 6.466 | 52.812 | 33.935 | 1.00 | 0.00 | XXXX | 6324 |
| HETATM | 6325 | O | HOH S | 479 | 7.813 | 51.866 | 60.949 | 1.00 | 0.00 | XXXX | 6325 |
| HETATM | 6326 | O | HOH S | 480 | 7.474 | 23.381 | 49.022 | 1.00 | 0.00 | XXXX | 6326 |
| HETATM | 6327 | O | HOH S | 481 | 2.109 | 32.523 | 32.075 | 1.00 | 0.00 | XXXX | 6327 |
| HETATM | 6328 | O | HOH S | 482 | 21.146 | 59.569 | 69.600 | 1.00 | 0.00 | XXXX | 6328 |
| HETATM | 6329 | O | HOH S | 483 | −6.117 | 71.350 | 17.974 | 1.00 | 0.00 | XXXX | 6329 |
| HETATM | 6330 | O | HOH S | 484 | −10.570 | 22.587 | 38.502 | 1.00 | 0.00 | XXXX | 6330 |
| HETATM | 6331 | O | HOH S | 485 | −10.624 | 57.283 | 51.874 | 1.00 | 0.00 | XXXX | 6331 |
| HETATM | 6332 | O | HOH S | 486 | 27.088 | 37.475 | 66.170 | 1.00 | 0.00 | XXXX | 6332 |
| HETATM | 6333 | O | HOH S | 487 | −27.887 | 25.867 | 40.426 | 1.00 | 0.00 | XXXX | 6333 |
| HETATM | 6334 | O | HOH S | 488 | −11.029 | 53.729 | 54.083 | 1.00 | 0.00 | XXXX | 6334 |
| HETATM | 6335 | O | HOH S | 489 | −22.498 | 33.312 | 20.633 | 1.00 | 0.00 | XXXX | 6335 |
| HETATM | 6336 | O | HOH S | 490 | 3.185 | 67.786 | 18.519 | 1.00 | 0.00 | XXXX | 6336 |
| HETATM | 6337 | O | HOH S | 491 | 42.058 | 38.319 | 63.255 | 1.00 | 0.00 | XXXX | 6337 |
| HETATM | 6338 | O | HOH S | 492 | 32.229 | 55.780 | 63.927 | 1.00 | 0.00 | XXXX | 6338 |
| HETATM | 6339 | O | HOH S | 493 | −25.506 | 31.633 | 22.120 | 1.00 | 0.00 | XXXX | 6339 |
| HETATM | 6340 | O | HOH S | 494 | 14.579 | 55.129 | 40.683 | 1.00 | 0.00 | XXXX | 6340 |
| HETATM | 6341 | O | HOH S | 495 | 11.433 | 35.739 | 69.226 | 1.00 | 0.00 | XXXX | 6341 |
| HETATM | 6342 | O | HOH S | 496 | −2.652 | 36.731 | 47.392 | 1.00 | 0.00 | XXXX | 6342 |
| HETATM | 6343 | O | HOH S | 497 | −20.753 | 64.357 | 29.227 | 1.00 | 0.00 | XXXX | 6343 |
| HETATM | 6344 | O | HOH S | 498 | 10.075 | 45.933 | 28.187 | 1.00 | 0.00 | XXXX | 6344 |
| HETATM | 6345 | O | HOH S | 499 | −22.394 | 50.307 | 56.261 | 1.00 | 0.00 | XXXX | 6345 |
| HETATM | 6346 | O | HOH S | 500 | −33.441 | 52.433 | 23.566 | 1.00 | 0.00 | XXXX | 6346 |
| HETATM | 6347 | O | HOH S | 501 | 12.008 | 27.594 | 60.971 | 1.00 | 0.00 | XXXX | 6347 |
| HETATM | 6348 | O | HOH S | 502 | −12.737 | 25.348 | 47.255 | 1.00 | 0.00 | XXXX | 6348 |
| HETATM | 6349 | O | HOH S | 503 | −36.291 | 38.225 | 22.753 | 1.00 | 0.00 | XXXX | 6349 |
| HETATM | 6350 | O | HOH S | 504 | −1.503 | 53.189 | 73.358 | 1.00 | 0.00 | XXXX | 6350 |
| HETATM | 6351 | O | HOH S | 505 | −11.783 | 31.796 | 26.994 | 1.00 | 0.00 | XXXX | 6351 |
| HETATM | 6352 | O | HOH S | 506 | 1.450 | 45.636 | 76.130 | 1.00 | 0.00 | XXXX | 6352 |
| HETATM | 6353 | O | HOH S | 507 | −2.806 | 69.196 | 31.083 | 1.00 | 0.00 | XXXX | 6353 |
| HETATM | 6354 | O | HOH S | 508 | 0.717 | 68.501 | 45.555 | 1.00 | 0.00 | XXXX | 6354 |
| HETATM | 6355 | O | HOH S | 509 | 4.379 | 32.623 | 33.023 | 1.00 | 0.00 | XXXX | 6355 |
| HETATM | 6356 | O | HOH S | 510 | 20.773 | 48.966 | 79.260 | 1.00 | 0.00 | XXXX | 6356 |
| HETATM | 6357 | O | HOH S | 511 | 4.954 | 60.620 | 43.034 | 1.00 | 0.00 | XXXX | 6357 |
| HETATM | 6358 | O | HOH S | 512 | 26.385 | 33.296 | 30.932 | 1.00 | 0.00 | XXXX | 6358 |
| HETATM | 6359 | O | HOH S | 513 | 8.730 | 28.283 | 42.348 | 1.00 | 0.00 | XXXX | 6359 |
| HETATM | 6360 | O | HOH S | 514 | −40.486 | 41.980 | 36.054 | 1.00 | 0.00 | XXXX | 6360 |
| HETATM | 6361 | O | HOH S | 515 | 7.652 | 58.689 | 37.252 | 1.00 | 0.00 | XXXX | 6361 |
| HETATM | 6362 | O | HOH S | 516 | −9.499 | 30.163 | 49.151 | 1.00 | 0.00 | XXXX | 6362 |
| HETATM | 6363 | O | HOH S | 517 | 10.101 | 22.888 | 52.994 | 1.00 | 0.00 | XXXX | 6363 |
| HETATM | 6364 | O | HOH S | 518 | 20.630 | 64.245 | 54.262 | 1.00 | 0.00 | XXXX | 6364 |
| HETATM | 6365 | O | HOH S | 519 | 34.892 | 50.150 | 47.211 | 1.00 | 0.00 | XXXX | 6365 |
| HETATM | 6366 | O | HOH S | 520 | 43.485 | 45.796 | 63.300 | 1.00 | 0.00 | XXXX | 6366 |
| HETATM | 6367 | O | HOH S | 521 | 13.675 | 37.191 | 71.129 | 1.00 | 0.00 | XXXX | 6367 |
| HETATM | 6368 | O | HOH S | 522 | 11.582 | 30.157 | 61.283 | 1.00 | 0.00 | XXXX | 6368 |
| HETATM | 6369 | O | HOH S | 523 | 26.778 | 35.205 | 32.107 | 1.00 | 0.00 | XXXX | 6369 |
| HETATM | 6370 | O | HOH S | 524 | −4.823 | 32.696 | 57.107 | 1.00 | 0.00 | XXXX | 6370 |
| HETATM | 6371 | O | HOH S | 525 | 21.239 | 67.611 | 57.403 | 1.00 | 0.00 | XXXX | 6371 |
| HETATM | 6372 | O | HOH S | 526 | −4.759 | 60.928 | 48.225 | 1.00 | 0.00 | XXXX | 6372 |

-continued

| | | | | | | | | | | |
|---|---|---|---|---|---|---|---|---|---|---|
| HETATM | 6373 | O | HOH S | 527 | −22.229 | 29.799 | 60.479 | 1.00 | 0.00 | XXXX | 6373 |
| HETATM | 6374 | O | HOH S | 528 | 5.425 | 68.675 | 34.631 | 1.00 | 0.00 | XXXX | 6374 |
| HETATM | 6375 | O | HOH S | 529 | −15.601 | 23.095 | 38.940 | 1.00 | 0.00 | XXXX | 6375 |
| HETATM | 6376 | O | HOH S | 530 | 9.047 | 66.572 | 43.235 | 1.00 | 0.00 | XXXX | 6376 |
| HETATM | 6377 | O | HOH S | 531 | 5.601 | 64.395 | 41.505 | 1.00 | 0.00 | XXXX | 6377 |
| HETATM | 6378 | O | HOH S | 532 | −12.951 | 37.584 | 17.013 | 1.00 | 0.00 | XXXX | 6378 |
| HETATM | 6379 | O | HOH S | 533 | −2.663 | 68.696 | 49.350 | 1.00 | 0.00 | XXXX | 6379 |
| HETATM | 6380 | O | HOH S | 534 | 33.975 | 41.068 | 70.009 | 1.00 | 0.00 | XXXX | 6380 |
| HETATM | 6381 | O | HOH S | 535 | −6.689 | 31.211 | 48.913 | 1.00 | 0.00 | XXXX | 6381 |
| HETATM | 6382 | O | HOH S | 536 | −26.752 | 25.017 | 50.130 | 1.00 | 0.00 | XXXX | 6382 |
| HETATM | 6383 | O | HOH S | 537 | −10.033 | 44.518 | 56.737 | 1.00 | 0.00 | XXXX | 6383 |
| HETATM | 6384 | O | HOH S | 538 | −3.463 | 61.798 | 11.466 | 1.00 | 0.00 | XXXX | 6384 |
| HETATM | 6385 | O | HOH S | 539 | 2.686 | 66.763 | 44.853 | 1.00 | 0.00 | XXXX | 6385 |
| HETATM | 6386 | O | HOH S | 540 | −38.889 | 46.517 | 29.892 | 1.00 | 0.00 | XXXX | 6386 |
| HETATM | 6387 | O | HOH S | 541 | −14.864 | 46.850 | 54.084 | 1.00 | 0.00 | XXXX | 6387 |
| HETATM | 6388 | O | HOH S | 542 | 36.744 | 51.002 | 53.140 | 1.00 | 0.00 | XXXX | 6388 |
| HETATM | 6389 | O | HOH S | 543 | 11.802 | 47.024 | 23.130 | 1.00 | 0.00 | XXXX | 6389 |
| HETATM | 6390 | O | HOH S | 544 | −23.606 | 51.151 | 19.173 | 1.00 | 0.00 | XXXX | 6390 |
| HETATM | 6391 | O | HOH S | 545 | 3.394 | 68.044 | 41.843 | 1.00 | 0.00 | XXXX | 6391 |
| HETATM | 6392 | O | HOH S | 546 | 2.340 | 33.739 | 22.333 | 1.00 | 0.00 | XXXX | 6392 |
| HETATM | 6393 | O | HOH S | 547 | 5.119 | 47.572 | 41.346 | 1.00 | 0.00 | XXXX | 6393 |
| HETATM | 6394 | O | HOH S | 548 | 40.799 | 41.567 | 54.882 | 1.00 | 0.00 | XXXX | 6394 |
| HETATM | 6395 | O | HOH S | 549 | −4.644 | 71.890 | 42.159 | 1.00 | 0.00 | XXXX | 6395 |
| HETATM | 6396 | O | HOH S | 550 | −6.487 | 37.222 | 18.613 | 1.00 | 0.00 | XXXX | 6396 |
| HETATM | 6397 | O | HOH S | 551 | −6.470 | 70.239 | 42.745 | 1.00 | 0.00 | XXXX | 6397 |
| HETATM | 6398 | O | HOH S | 552 | −7.932 | 51.498 | 55.177 | 1.00 | 0.00 | XXXX | 6398 |
| HETATM | 6399 | O | HOH S | 553 | −34.698 | 50.438 | 43.930 | 1.00 | 0.00 | XXXX | 6399 |
| HETATM | 6400 | O | HOH S | 554 | −13.581 | 37.543 | 19.644 | 1.00 | 0.00 | XXXX | 6400 |
| HETATM | 6401 | O | HOH S | 555 | −7.667 | 52.512 | 29.947 | 1.00 | 0.00 | XXXX | 6401 |
| HETATM | 6402 | O | HOH S | 556 | 12.400 | 68.640 | 72.874 | 1.00 | 0.00 | XXXX | 6402 |
| HETATM | 6403 | O | HOH S | 557 | 14.987 | 25.724 | 42.736 | 1.00 | 0.00 | XXXX | 6403 |
| HETATM | 6404 | O | HOH S | 558 | −16.154 | 59.463 | 48.714 | 1.00 | 0.00 | XXXX | 6404 |
| HETATM | 6405 | O | HOH S | 559 | 12.715 | 64.116 | 74.090 | 1.00 | 0.00 | XXXX | 6405 |
| HETATM | 6406 | O | HOH S | 560 | −35.958 | 28.308 | 45.048 | 1.00 | 0.00 | XXXX | 6406 |
| HETATM | 6407 | O | HOH S | 561 | −10.888 | 34.519 | 56.279 | 1.00 | 0.00 | XXXX | 6407 |
| HETATM | 6408 | O | HOH S | 562 | −21.272 | 49.158 | 11.960 | 1.00 | 0.00 | XXXX | 6408 |
| HETATM | 6409 | O | HOH S | 563 | −7.672 | 72.208 | 24.524 | 1.00 | 0.00 | XXXX | 6409 |
| HETATM | 6410 | O | HOH S | 564 | −28.296 | 46.350 | 18.638 | 1.00 | 0.00 | XXXX | 6410 |
| HETATM | 6411 | O | HOH S | 565 | −21.740 | 24.054 | 44.753 | 1.00 | 0.00 | XXXX | 6411 |
| HETATM | 6412 | O | HOH S | 566 | −16.237 | 66.161 | 43.448 | 1.00 | 0.00 | XXXX | 6412 |
| HETATM | 6413 | O | HOH S | 567 | 10.928 | 59.368 | 79.601 | 1.00 | 0.00 | XXXX | 6413 |
| HETATM | 6414 | O | HOH S | 568 | 19.489 | 45.085 | 78.478 | 1.00 | 0.00 | XXXX | 6414 |
| HETATM | 6415 | O | HOH S | 569 | −17.743 | 34.507 | 58.235 | 1.00 | 0.00 | XXXX | 6415 |
| HETATM | 6416 | O | HOH S | 570 | −14.162 | 26.789 | 28.480 | 1.00 | 0.00 | XXXX | 6416 |
| HETATM | 6417 | O | HOH S | 571 | 20.769 | 67.236 | 68.110 | 1.00 | 0.00 | XXXX | 6417 |
| HETATM | 6418 | O | HOH S | 572 | −25.205 | 63.659 | 33.901 | 1.00 | 0.00 | XXXX | 6418 |
| HETATM | 6419 | O | HOH S | 573 | −9.314 | 46.335 | 65.282 | 1.00 | 0.00 | XXXX | 6419 |
| HETATM | 6420 | O | HOH S | 574 | −11.570 | 74.367 | 28.200 | 1.00 | 0.00 | XXXX | 6420 |
| HETATM | 6421 | O | HOH S | 575 | 10.555 | 56.773 | 39.168 | 1.00 | 0.00 | XXXX | 6421 |
| HETATM | 6422 | O | HOH S | 576 | −3.872 | 49.050 | 49.868 | 1.00 | 0.00 | XXXX | 6422 |
| HETATM | 6423 | O | HOH S | 577 | 15.489 | 54.128 | 38.915 | 1.00 | 0.00 | XXXX | 6423 |
| HETATM | 6424 | O | HOH S | 578 | −3.415 | 41.515 | 47.513 | 1.00 | 0.00 | XXXX | 6424 |
| HETATM | 6425 | O | HOH S | 579 | 16.062 | 19.827 | 63.322 | 1.00 | 0.00 | XXXX | 6425 |
| HETATM | 6426 | O | HOH S | 580 | −8.683 | 53.494 | 58.438 | 1.00 | 0.00 | XXXX | 6426 |
| HETATM | 6427 | O | HOH S | 581 | −6.947 | 43.804 | 15.520 | 1.00 | 0.00 | XXXX | 6427 |
| HETATM | 6428 | O | HOH S | 582 | 16.531 | 59.696 | 42.483 | 1.00 | 0.00 | XXXX | 6428 |
| HETATM | 6429 | O | HOH S | 583 | −14.254 | 27.697 | 53.827 | 1.00 | 0.00 | XXXX | 6429 |
| HETATM | 6430 | O | HOH S | 584 | 6.711 | 65.761 | 43.827 | 1.00 | 0.00 | XXXX | 6430 |
| HETATM | 6431 | O | HOH S | 585 | 11.342 | 25.724 | 58.481 | 1.00 | 0.00 | XXXX | 6431 |
| HETATM | 6432 | O | HOH S | 586 | 11.018 | 67.597 | 42.699 | 1.00 | 0.00 | XXXX | 6432 |
| HETATM | 6433 | O | HOH S | 587 | 24.333 | 27.530 | 52.676 | 1.00 | 0.00 | XXXX | 6433 |
| HETATM | 6434 | O | HOH S | 588 | −31.577 | 53.934 | 26.993 | 1.00 | 0.00 | XXXX | 6434 |
| HETATM | 6435 | O | HOH S | 589 | −34.759 | 50.660 | 39.667 | 1.00 | 0.00 | XXXX | 6435 |
| HETATM | 6436 | O | HOH S | 590 | 10.948 | 35.119 | 34.464 | 1.00 | 0.00 | XXXX | 6436 |
| HETATM | 6437 | O | HOH S | 591 | 15.554 | 62.750 | 39.153 | 1.00 | 0.00 | XXXX | 6437 |
| HETATM | 6438 | O | HOH S | 592 | 8.738 | 53.695 | 32.519 | 1.00 | 0.00 | XXXX | 6438 |
| HETATM | 6439 | O | HOH S | 593 | 26.416 | 28.357 | 63.417 | 1.00 | 0.00 | XXXX | 6439 |
| HETATM | 6440 | O | HOH S | 594 | 8.381 | 43.024 | 28.049 | 1.00 | 0.00 | XXXX | 6440 |
| HETATM | 6441 | O | HOH S | 595 | −2.297 | 41.214 | 44.334 | 1.00 | 0.00 | XXXX | 6441 |
| HETATM | 6442 | O | HOH S | 596 | −8.712 | 43.529 | 62.035 | 1.00 | 0.00 | XXXX | 6442 |
| HETATM | 6443 | O | HOH S | 597 | 24.684 | 48.643 | 73.090 | 1.00 | 0.00 | XXXX | 6443 |
| HETATM | 6444 | O | HOH S | 598 | 25.310 | 32.130 | 68.870 | 1.00 | 0.00 | XXXX | 6444 |
| HETATM | 6445 | O | HOH S | 599 | −1.514 | 31.101 | 69.029 | 1.00 | 0.00 | XXXX | 6445 |
| HETATM | 6446 | O | HOH S | 600 | −19.714 | 62.336 | 22.782 | 1.00 | 0.00 | XXXX | 6446 |
| HETATM | 6447 | O | HOH S | 601 | 9.448 | 67.976 | 35.382 | 1.00 | 0.00 | XXXX | 6447 |
| HETATM | 6448 | O | HOH S | 602 | −0.645 | 68.817 | 23.665 | 1.00 | 0.00 | XXXX | 6448 |
| HETATM | 6449 | O | HOH S | 603 | 18.421 | 19.792 | 43.611 | 1.00 | 0.00 | XXXX | 6449 |
| HETATM | 6450 | O | HOH S | 604 | −14.303 | 42.157 | 58.083 | 1.00 | 0.00 | XXXX | 6450 |
| HETATM | 6451 | O | HOH S | 605 | −25.344 | 59.111 | 43.380 | 1.00 | 0.00 | XXXX | 6451 |

-continued

| | | | | | | | | | | |
|---|---|---|---|---|---|---|---|---|---|---|
| HETATM | 6452 | O | HOH S | 606 | −3.477 | 44.179 | 44.176 | 1.00 | 0.00 | XXXX | 6452 |
| HETATM | 6453 | O | HOH S | 607 | −4.523 | 68.035 | 29.269 | 1.00 | 0.00 | XXXX | 6453 |
| HETATM | 6454 | O | HOH S | 608 | −8.978 | 67.758 | 15.387 | 1.00 | 0.00 | XXXX | 6454 |
| HETATM | 6455 | O | HOH S | 609 | 0.887 | 32.452 | 29.378 | 1.00 | 0.00 | XXXX | 6455 |
| HETATM | 6456 | O | HOH S | 610 | 2.749 | 39.313 | 45.943 | 1.00 | 0.00 | XXXX | 6456 |
| HETATM | 6457 | O | HOH S | 611 | 1.353 | 31.297 | 21.100 | 1.00 | 0.00 | XXXX | 6457 |
| HETATM | 6458 | O | HOH S | 612 | −21.473 | 46.868 | 61.541 | 1.00 | 0.00 | XXXX | 6458 |
| HETATM | 6459 | O | HOH S | 613 | 13.251 | 61.166 | 79.889 | 1.00 | 0.00 | XXXX | 6459 |
| HETATM | 6460 | O | HOH S | 614 | −8.817 | 45.358 | 15.887 | 1.00 | 0.00 | XXXX | 6460 |
| HETATM | 6461 | O | HOH S | 615 | −7.873 | 75.792 | 41.694 | 1.00 | 0.00 | XXXX | 6461 |
| HETATM | 6462 | O | HOH S | 616 | −0.010 | 30.612 | 57.399 | 1.00 | 0.00 | XXXX | 6462 |
| HETATM | 6463 | O | HOH S | 617 | 14.778 | 32.894 | 33.689 | 1.00 | 0.00 | XXXX | 6463 |
| HETATM | 6464 | O | HOH S | 618 | −14.824 | 68.964 | 40.252 | 1.00 | 0.00 | XXXX | 6464 |
| HETATM | 6465 | O | HOH S | 619 | 19.545 | 24.815 | 46.021 | 1.00 | 0.00 | XXXX | 6465 |
| HETATM | 6466 | O | HOH S | 620 | −22.345 | 63.435 | 34.476 | 1.00 | 0.00 | XXXX | 6466 |
| HETATM | 6467 | O | HOH S | 621 | −9.586 | 63.883 | 8.984 | 1.00 | 0.00 | XXXX | 6467 |
| HETATM | 6468 | O | HOH S | 622 | −10.184 | 58.117 | 58.409 | 1.00 | 0.00 | XXXX | 6468 |
| HETATM | 6469 | O | HOH S | 623 | 25.893 | 25.329 | 40.761 | 1.00 | 0.00 | XXXX | 6469 |
| HETATM | 6470 | O | HOH S | 624 | 18.515 | 61.892 | 42.078 | 1.00 | 0.00 | XXXX | 6470 |
| HETATM | 6471 | O | HOH S | 625 | 2.685 | 41.181 | 44.207 | 1.00 | 0.00 | XXXX | 6471 |
| HETATM | 6472 | O | HOH S | 626 | −38.534 | 58.049 | 25.801 | 1.00 | 0.00 | XXXX | 6472 |
| HETATM | 6473 | O | HOH S | 627 | −27.253 | 49.227 | 54.712 | 1.00 | 0.00 | XXXX | 6473 |
| HETATM | 6474 | O | HOH S | 628 | −13.191 | 72.632 | 27.140 | 1.00 | 0.00 | XXXX | 6474 |
| HETATM | 6475 | O | HOH S | 629 | 16.614 | 41.086 | 31.699 | 1.00 | 0.00 | XXXX | 6475 |
| HETATM | 6476 | O | HOH S | 630 | 38.760 | 43.643 | 54.402 | 1.00 | 0.00 | XXXX | 6476 |
| HETATM | 6477 | O | HOH S | 631 | −16.895 | 61.100 | 19.929 | 1.00 | 0.00 | XXXX | 6477 |
| HETATM | 6478 | O | HOH S | 632 | 8.739 | 19.963 | 44.550 | 1.00 | 0.00 | XXXX | 6478 |
| HETATM | 6479 | O | HOH S | 633 | 16.906 | 53.700 | 78.265 | 1.00 | 0.00 | XXXX | 6479 |
| HETATM | 6480 | O | HOH S | 634 | 7.455 | 27.702 | 57.100 | 1.00 | 0.00 | XXXX | 6480 |
| HETATM | 6481 | O | HOH S | 635 | 4.488 | 65.991 | 15.259 | 1.00 | 0.00 | XXXX | 6481 |
| HETATM | 6482 | O | HOH S | 636 | −23.997 | 61.952 | 30.808 | 1.00 | 0.00 | XXXX | 6482 |
| HETATM | 6483 | O | HOH S | 637 | 12.616 | 73.190 | 50.358 | 1.00 | 0.00 | XXXX | 6483 |
| HETATM | 6484 | O | HOH S | 638 | −18.254 | 63.331 | 50.179 | 1.00 | 0.00 | XXXX | 6484 |
| HETATM | 6485 | O | HOH S | 639 | 3.605 | 44.071 | 46.684 | 1.00 | 0.00 | XXXX | 6485 |
| HETATM | 6486 | O | HOH S | 640 | −17.585 | 60.712 | 16.203 | 1.00 | 0.00 | XXXX | 6486 |
| HETATM | 6487 | O | HOH S | 641 | −10.703 | 45.034 | 14.953 | 1.00 | 0.00 | XXXX | 6487 |
| HETATM | 6488 | O | HOH S | 642 | −26.581 | 56.739 | 35.171 | 1.00 | 0.00 | XXXX | 6488 |
| HETATM | 6489 | O | HOH S | 643 | −14.992 | 52.536 | 52.873 | 1.00 | 0.00 | XXXX | 6489 |
| HETATM | 6490 | O | HOH S | 644 | −6.199 | 42.059 | 48.225 | 1.00 | 0.00 | XXXX | 6490 |
| HETATM | 6491 | O | HOH S | 645 | 3.440 | 61.126 | 79.559 | 1.00 | 0.00 | XXXX | 6491 |
| HETATM | 6492 | O | HOH S | 646 | −14.915 | 34.609 | 19.950 | 1.00 | 0.00 | XXXX | 6492 |
| HETATM | 6493 | O | HOH S | 647 | 32.508 | 53.060 | 48.010 | 1.00 | 0.00 | XXXX | 6493 |
| HETATM | 6494 | O | HOH S | 648 | 25.157 | 47.661 | 31.147 | 1.00 | 0.00 | XXXX | 6494 |
| HETATM | 6495 | O | HOH S | 649 | −5.411 | 52.506 | 31.480 | 1.00 | 0.00 | XXXX | 6495 |
| HETATM | 6496 | O | HOH S | 650 | 11.157 | 71.803 | 69.407 | 1.00 | 0.00 | XXXX | 6496 |
| HETATM | 6497 | O | HOH S | 651 | 19.480 | 65.706 | 51.187 | 1.00 | 0.00 | XXXX | 6497 |
| HETATM | 6498 | O | HOH S | 652 | 9.607 | 58.200 | 34.943 | 1.00 | 0.00 | XXXX | 6498 |
| HETATM | 6499 | O | HOH S | 653 | −22.797 | 37.286 | 60.731 | 1.00 | 0.00 | XXXX | 6499 |
| HETATM | 6500 | O | HOH S | 654 | −8.832 | 27.696 | 48.215 | 1.00 | 0.00 | XXXX | 6500 |
| HETATM | 6501 | O | HOH S | 655 | 34.018 | 42.932 | 32.302 | 1.00 | 0.00 | XXXX | 6501 |
| HETATM | 6502 | O | HOH S | 656 | 24.327 | 60.716 | 51.312 | 1.00 | 0.00 | XXXX | 6502 |
| HETATM | 6503 | O | HOH S | 657 | 13.024 | 71.288 | 68.348 | 1.00 | 0.00 | XXXX | 6503 |
| HETATM | 6504 | O | HOH S | 658 | −8.490 | 37.498 | 61.852 | 1.00 | 0.00 | XXXX | 6504 |
| HETATM | 6505 | O | HOH S | 659 | −17.917 | 60.796 | 49.547 | 1.00 | 0.00 | XXXX | 6505 |
| HETATM | 6506 | O | HOH S | 660 | 16.387 | 61.601 | 70.493 | 1.00 | 0.00 | XXXX | 6506 |
| HETATM | 6507 | O | HOH S | 661 | 13.583 | 38.874 | 76.335 | 1.00 | 0.00 | XXXX | 6507 |
| HETATM | 6508 | O | HOH S | 662 | 10.632 | 33.131 | 35.693 | 1.00 | 0.00 | XXXX | 6508 |
| HETATM | 6509 | O | HOH S | 663 | −28.568 | 47.301 | 16.677 | 1.00 | 0.00 | XXXX | 6509 |
| HETATM | 6510 | O | HOH S | 664 | 24.539 | 35.767 | 69.936 | 1.00 | 0.00 | XXXX | 6510 |
| HETATM | 6511 | O | HOH S | 665 | 27.955 | 30.070 | 65.323 | 1.00 | 0.00 | XXXX | 6511 |
| HETATM | 6512 | O | HOH S | 666 | 14.341 | 26.005 | 61.997 | 1.00 | 0.00 | XXXX | 6512 |
| HETATM | 6513 | O | HOH S | 667 | 28.165 | 46.588 | 72.809 | 1.00 | 0.00 | XXXX | 6513 |
| HETATM | 6514 | O | HOH S | 668 | 2.648 | 71.598 | 47.450 | 1.00 | 0.00 | XXXX | 6514 |
| HETATM | 6515 | O | HOH S | 669 | −2.048 | 33.326 | 68.232 | 1.00 | 0.00 | XXXX | 6515 |
| HETATM | 6516 | O | HOH S | 670 | 27.736 | 26.238 | 51.918 | 1.00 | 0.00 | XXXX | 6516 |
| HETATM | 6517 | O | HOH S | 671 | 1.983 | 32.452 | 48.886 | 1.00 | 0.00 | XXXX | 6517 |
| HETATM | 6518 | O | HOH S | 672 | 24.625 | 42.548 | 71.115 | 1.00 | 0.00 | XXXX | 6518 |
| HETATM | 6519 | O | HOH S | 673 | 4.943 | 67.943 | 61.873 | 1.00 | 0.00 | XXXX | 6519 |
| HETATM | 6520 | O | HOH S | 674 | −36.723 | 50.587 | 38.047 | 1.00 | 0.00 | XXXX | 6520 |
| HETATM | 6521 | O | HOH S | 675 | 0.649 | 40.873 | 45.414 | 1.00 | 0.00 | XXXX | 6521 |
| HETATM | 6522 | O | HOH S | 676 | 17.112 | 51.931 | 78.733 | 1.00 | 0.00 | XXXX | 6522 |
| HETATM | 6523 | O | HOH S | 677 | −5.002 | 30.307 | 19.077 | 1.00 | 0.00 | XXXX | 6523 |
| HETATM | 6524 | O | HOH S | 678 | −30.729 | 50.798 | 50.598 | 1.00 | 0.00 | XXXX | 6524 |
| HETATM | 6525 | O | HOH S | 679 | −12.583 | 48.622 | 58.948 | 1.00 | 0.00 | XXXX | 6525 |
| HETATM | 6526 | O | HOH S | 680 | 14.921 | 23.371 | 61.150 | 1.00 | 0.00 | XXXX | 6526 |
| HETATM | 6527 | O | HOH S | 681 | 22.883 | 63.202 | 52.948 | 1.00 | 0.00 | XXXX | 6527 |
| HETATM | 6528 | O | HOH S | 682 | −38.982 | 27.853 | 36.895 | 1.00 | 0.00 | XXXX | 6528 |
| HETATM | 6529 | O | HOH S | 683 | 24.066 | 51.826 | 77.536 | 1.00 | 0.00 | XXXX | 6529 |
| HETATM | 6530 | O | HOH S | 684 | −8.481 | 40.459 | 61.248 | 1.00 | 0.00 | XXXX | 6530 |

-continued

| | | | | | | | | | | |
|---|---|---|---|---|---|---|---|---|---|---|
| HETATM | 6531 | O | HOH S | 685 | −11.012 | 52.613 | 58.831 | 1.00 | 0.00 | XXXX | 6531 |
| HETATM | 6532 | O | HOH S | 686 | 11.471 | 54.810 | 37.062 | 1.00 | 0.00 | XXXX | 6532 |
| HETATM | 6533 | O | HOH S | 687 | −6.270 | 70.222 | 26.573 | 1.00 | 0.00 | XXXX | 6533 |
| HETATM | 6534 | O | HOH S | 688 | 6.415 | 70.022 | 60.235 | 1.00 | 0.00 | XXXX | 6534 |
| HETATM | 6535 | O | HOH S | 689 | −3.622 | 59.382 | 10.586 | 1.00 | 0.00 | XXXX | 6535 |
| HETATM | 6536 | O | HOH S | 690 | 12.040 | 47.457 | 31.596 | 1.00 | 0.00 | XXXX | 6536 |
| HETATM | 6537 | O | HOH S | 691 | −38.319 | 28.337 | 41.109 | 1.00 | 0.00 | XXXX | 6537 |
| HETATM | 6538 | O | HOH S | 692 | 4.558 | 67.442 | 26.648 | 1.00 | 0.00 | XXXX | 6538 |
| HETATM | 6539 | O | HOH S | 693 | −22.058 | 27.800 | 24.949 | 1.00 | 0.00 | XXXX | 6539 |
| HETATM | 6540 | O | HOH S | 694 | −7.227 | 23.212 | 41.360 | 1.00 | 0.00 | XXXX | 6540 |
| HETATM | 6541 | O | HOH S | 695 | 3.137 | 69.800 | 17.456 | 1.00 | 0.00 | XXXX | 6541 |
| HETATM | 6542 | O | HOH S | 696 | −25.732 | 59.347 | 21.930 | 1.00 | 0.00 | XXXX | 6542 |
| HETATM | 6543 | O | HOH S | 697 | −36.115 | 45.989 | 47.890 | 1.00 | 0.00 | XXXX | 6543 |
| HETATM | 6544 | O | HOH S | 698 | −15.361 | 62.404 | 52.130 | 1.00 | 0.00 | XXXX | 6544 |
| HETATM | 6545 | O | HOH S | 699 | 5.565 | 27.133 | 46.315 | 1.00 | 0.00 | XXXX | 6545 |
| HETATM | 6546 | O | HOH S | 700 | −10.187 | 45.988 | 62.513 | 1.00 | 0.00 | XXXX | 6546 |
| HETATM | 6547 | O | HOH S | 701 | 37.028 | 51.077 | 61.782 | 1.00 | 0.00 | XXXX | 6547 |
| HETATM | 6548 | O | HOH S | 702 | 21.280 | 29.311 | 30.776 | 1.00 | 0.00 | XXXX | 6548 |
| HETATM | 6549 | O | HOH S | 703 | −21.806 | 37.691 | 17.673 | 1.00 | 0.00 | XXXX | 6549 |
| HETATM | 6550 | O | HOH S | 704 | 38.559 | 50.484 | 59.776 | 1.00 | 0.00 | XXXX | 6550 |
| HETATM | 6551 | O | HOH S | 705 | 28.707 | 26.766 | 39.742 | 1.00 | 0.00 | XXXX | 6551 |
| HETATM | 6552 | O | HOH S | 706 | −6.648 | 38.178 | 64.711 | 1.00 | 0.00 | XXXX | 6552 |
| HETATM | 6553 | O | HOH S | 707 | 26.332 | 61.258 | 57.229 | 1.00 | 0.00 | XXXX | 6553 |
| HETATM | 6554 | O | HOH S | 708 | −5.879 | 31.360 | 46.876 | 1.00 | 0.00 | XXXX | 6554 |
| HETATM | 6555 | O | HOH S | 709 | −19.857 | 64.886 | 37.210 | 1.00 | 0.00 | XXXX | 6555 |
| HETATM | 6556 | O | HOH S | 710 | −40.217 | 28.554 | 34.544 | 1.00 | 0.00 | XXXX | 6556 |
| HETATM | 6557 | O | HOH S | 711 | 4.664 | 69.577 | 38.800 | 1.00 | 0.00 | XXXX | 6557 |
| HETATM | 6558 | O | HOH S | 712 | 22.313 | 20.954 | 49.405 | 1.00 | 0.00 | XXXX | 6558 |
| HETATM | 6559 | O | HOH S | 713 | 21.463 | 37.018 | 72.833 | 1.00 | 0.00 | XXXX | 6559 |
| HETATM | 6560 | O | HOH S | 714 | 12.743 | 37.879 | 73.657 | 1.00 | 0.00 | XXXX | 6560 |
| HETATM | 6561 | O | HOH S | 715 | 9.637 | 35.081 | 70.991 | 1.00 | 0.00 | XXXX | 6561 |
| HETATM | 6562 | O | HOH S | 716 | 33.904 | 58.502 | 64.528 | 1.00 | 0.00 | XXXX | 6562 |
| HETATM | 6563 | O | HOH S | 717 | 2.474 | 66.451 | 27.146 | 1.00 | 0.00 | XXXX | 6563 |
| HETATM | 6564 | O | HOH S | 718 | −4.775 | 63.209 | 49.237 | 1.00 | 0.00 | XXXX | 6564 |
| HETATM | 6565 | O | HOH S | 719 | 31.760 | 52.818 | 64.061 | 1.00 | 0.00 | XXXX | 6565 |
| HETATM | 6566 | O | HOH S | 720 | −21.085 | 67.820 | 29.354 | 1.00 | 0.00 | XXXX | 6566 |
| HETATM | 6567 | O | HOH S | 721 | −22.587 | 63.309 | 32.528 | 1.00 | 0.00 | XXXX | 6567 |
| HETATM | 6568 | O | HOH S | 722 | −25.865 | 61.002 | 24.161 | 1.00 | 0.00 | XXXX | 6568 |
| HETATM | 6569 | O | HOH S | 723 | −0.806 | 69.159 | 64.304 | 1.00 | 0.00 | XXXX | 6569 |
| HETATM | 6570 | O | HOH S | 724 | 29.454 | 28.174 | 37.273 | 1.00 | 0.00 | XXXX | 6570 |
| HETATM | 6571 | O | HOH S | 725 | 5.985 | 72.681 | 58.809 | 1.00 | 0.00 | XXXX | 6571 |
| HETATM | 6572 | O | HOH S | 726 | −2.218 | 66.617 | 63.830 | 1.00 | 0.00 | XXXX | 6572 |
| HETATM | 6573 | O | HOH S | 727 | −22.071 | 49.195 | 59.119 | 1.00 | 0.00 | XXXX | 6573 |
| HETATM | 6574 | O | HOH S | 728 | −2.414 | 72.585 | 16.770 | 1.00 | 0.00 | XXXX | 6574 |
| HETATM | 6575 | O | HOH S | 729 | 14.550 | 50.107 | 36.158 | 1.00 | 0.00 | XXXX | 6575 |
| HETATM | 6576 | O | HOH S | 730 | 11.838 | 69.413 | 49.589 | 1.00 | 0.00 | XXXX | 6576 |
| HETATM | 6577 | O | HOH S | 731 | −13.044 | 30.877 | 19.324 | 1.00 | 0.00 | XXXX | 6577 |
| HETATM | 6578 | O | HOH S | 732 | −14.909 | 33.857 | 17.589 | 1.00 | 0.00 | XXXX | 6578 |
| HETATM | 6579 | O | HOH S | 733 | 12.908 | 55.927 | 35.408 | 1.00 | 0.00 | XXXX | 6579 |
| HETATM | 6580 | O | HOH S | 734 | −10.066 | 36.878 | 16.454 | 1.00 | 0.00 | XXXX | 6580 |
| HETATM | 6581 | O | HOH S | 735 | 9.016 | 41.149 | 26.700 | 1.00 | 0.00 | XXXX | 6581 |
| HETATM | 6582 | O | HOH S | 736 | −39.348 | 51.114 | 18.333 | 1.00 | 0.00 | XXXX | 6582 |
| HETATM | 6583 | O | HOH S | 737 | −17.203 | 28.960 | 25.219 | 1.00 | 0.00 | XXXX | 6583 |
| HETATM | 6584 | O | HOH S | 738 | 19.982 | 61.319 | 49.197 | 1.00 | 0.00 | XXXX | 6584 |
| HETATM | 6585 | O | HOH S | 739 | −20.325 | 30.158 | 23.241 | 1.00 | 0.00 | XXXX | 6585 |
| HETATM | 6586 | O | HOH S | 740 | −5.940 | 54.861 | 11.869 | 1.00 | 0.00 | XXXX | 6586 |
| HETATM | 6587 | O | HOH S | 741 | 4.979 | 75.183 | 56.623 | 1.00 | 0.00 | XXXX | 6587 |
| HETATM | 6588 | O | HOH S | 742 | −1.528 | 41.768 | 64.931 | 1.00 | 0.00 | XXXX | 6588 |
| HETATM | 6589 | O | HOH S | 743 | −27.293 | 51.766 | 51.774 | 1.00 | 0.00 | XXXX | 6589 |
| HETATM | 6590 | O | HOH S | 744 | −14.481 | 44.561 | 15.399 | 1.00 | 0.00 | XXXX | 6590 |
| HETATM | 6591 | O | HOH S | 745 | 28.127 | 33.618 | 33.171 | 1.00 | 0.00 | XXXX | 6591 |
| HETATM | 6592 | O | HOH S | 746 | 19.167 | 20.086 | 46.695 | 1.00 | 0.00 | XXXX | 6592 |
| HETATM | 6593 | O | HOH S | 747 | 1.772 | 42.015 | 25.903 | 1.00 | 0.00 | XXXX | 6593 |
| HETATM | 6594 | O | HOH S | 748 | 8.954 | 45.820 | 30.597 | 1.00 | 0.00 | XXXX | 6594 |
| HETATM | 6595 | O | HOH S | 749 | −5.387 | 47.402 | 49.608 | 1.00 | 0.00 | XXXX | 6595 |
| HETATM | 6596 | O | HOH S | 750 | 7.856 | 52.117 | 36.032 | 1.00 | 0.00 | XXXX | 6596 |
| HETATM | 6597 | O | HOH S | 751 | −5.519 | 41.976 | 16.113 | 1.00 | 0.00 | XXXX | 6597 |
| HETATM | 6598 | O | HOH S | 752 | −35.826 | 44.709 | 52.938 | 1.00 | 0.00 | XXXX | 6598 |
| HETATM | 6599 | O | HOH S | 753 | 12.547 | 21.090 | 41.921 | 1.00 | 0.00 | XXXX | 6599 |
| HETATM | 6600 | O | HOH S | 754 | 38.911 | 44.743 | 51.145 | 1.00 | 0.00 | XXXX | 6600 |
| HETATM | 6601 | O | HOH S | 755 | 10.564 | 67.673 | 28.165 | 1.00 | 0.00 | XXXX | 6601 |
| HETATM | 6602 | O | HOH S | 756 | 2.624 | 74.574 | 57.833 | 1.00 | 0.00 | XXXX | 6602 |
| HETATM | 6603 | O | HOH S | 757 | 32.290 | 28.920 | 45.727 | 1.00 | 0.00 | XXXX | 6603 |
| HETATM | 6604 | O | HOH S | 758 | −7.105 | 53.078 | 32.682 | 1.00 | 0.00 | XXXX | 6604 |
| HETATM | 6605 | O | HOH S | 759 | 19.269 | 51.169 | 78.558 | 1.00 | 0.00 | XXXX | 6605 |
| HETATM | 6606 | O | HOH S | 760 | −27.824 | 49.407 | 17.099 | 1.00 | 0.00 | XXXX | 6606 |
| HETATM | 6607 | O | HOH S | 761 | 7.100 | 46.499 | 31.497 | 1.00 | 0.00 | XXXX | 6607 |
| HETATM | 6608 | O | HOH S | 762 | 17.898 | 70.441 | 57.963 | 1.00 | 0.00 | XXXX | 6608 |
| HETATM | 6609 | O | HOH S | 763 | −13.968 | 50.747 | 54.305 | 1.00 | 0.00 | XXXX | 6609 |

-continued

| | | | | | | | | | | |
|---|---|---|---|---|---|---|---|---|---|---|
| HETATM | 6610 | O | HOH S | 764 | 9.746 | 26.963 | 60.651 | 1.00 | 0.00 | XXXX | 6610 |
| HETATM | 6611 | O | HOH S | 765 | −33.341 | 55.725 | 27.503 | 1.00 | 0.00 | XXXX | 6611 |
| HETATM | 6612 | O | HOH S | 766 | 10.335 | 76.971 | 51.340 | 1.00 | 0.00 | XXXX | 6612 |
| HETATM | 6613 | O | HOH S | 767 | −4.505 | 27.949 | 27.150 | 1.00 | 0.00 | XXXX | 6613 |
| HETATM | 6614 | O | HOH S | 768 | −0.216 | 74.213 | 16.627 | 1.00 | 0.00 | XXXX | 6614 |
| HETATM | 6615 | O | HOH S | 769 | −6.401 | 40.349 | 17.056 | 1.00 | 0.00 | XXXX | 6615 |
| HETATM | 6616 | O | HOH S | 770 | −6.126 | 48.023 | 67.363 | 1.00 | 0.00 | XXXX | 6616 |
| HETATM | 6617 | O | HOH S | 771 | −38.535 | 29.040 | 55.425 | 1.00 | 0.00 | XXXX | 6617 |
| HETATM | 6618 | O | HOH S | 772 | 20.525 | 57.506 | 43.457 | 1.00 | 0.00 | XXXX | 6618 |
| HETATM | 6619 | O | HOH S | 773 | 11.325 | 41.053 | 26.006 | 1.00 | 0.00 | XXXX | 6619 |
| HETATM | 6620 | O | HOH S | 774 | −10.111 | 74.427 | 37.857 | 1.00 | 0.00 | XXXX | 6620 |
| HETATM | 6621 | O | HOH S | 775 | −31.861 | 29.041 | 45.881 | 1.00 | 0.00 | XXXX | 6621 |
| HETATM | 6622 | O | HOH S | 776 | 33.679 | 51.909 | 67.937 | 1.00 | 0.00 | XXXX | 6622 |
| HETATM | 6623 | O | HOH S | 777 | 23.598 | 57.435 | 72.986 | 1.00 | 0.00 | XXXX | 6623 |
| HETATM | 6624 | O | HOH S | 778 | −30.401 | 26.146 | 41.623 | 1.00 | 0.00 | XXXX | 6624 |
| HETATM | 6625 | O | HOH S | 779 | −17.634 | 64.319 | 44.278 | 1.00 | 0.00 | XXXX | 6625 |
| HETATM | 6626 | O | HOH S | 780 | −9.143 | 35.713 | 19.227 | 1.00 | 0.00 | XXXX | 6626 |
| HETATM | 6627 | O | HOH S | 781 | −35.501 | 28.064 | 42.905 | 1.00 | 0.00 | XXXX | 6627 |
| HETATM | 6628 | O | HOH S | 782 | −3.573 | 28.828 | 40.210 | 1.00 | 0.00 | XXXX | 6628 |
| HETATM | 6629 | O | HOH S | 783 | −0.574 | 68.728 | 75.124 | 1.00 | 0.00 | XXXX | 6629 |
| HETATM | 6630 | O | HOH S | 784 | −13.447 | 38.447 | 14.717 | 1.00 | 0.00 | XXXX | 6630 |
| HETATM | 6631 | O | HOH S | 785 | 1.730 | 43.426 | 45.712 | 1.00 | 0.00 | XXXX | 6631 |
| HETATM | 6632 | O | HOH S | 786 | −4.308 | 25.122 | 39.219 | 1.00 | 0.00 | XXXX | 6632 |
| HETATM | 6633 | O | HOH S | 787 | −14.976 | 70.487 | 38.583 | 1.00 | 0.00 | XXXX | 6633 |
| HETATM | 6634 | O | HOH S | 788 | −22.975 | 54.219 | 13.549 | 1.00 | 0.00 | XXXX | 6634 |
| HETATM | 6635 | O | HOH S | 789 | 16.156 | 67.008 | 46.982 | 1.00 | 0.00 | XXXX | 6635 |
| HETATM | 6636 | O | HOH S | 790 | 2.164 | 45.511 | 43.355 | 1.00 | 0.00 | XXXX | 6636 |
| HETATM | 6637 | O | HOH S | 791 | −16.308 | 41.119 | 58.933 | 1.00 | 0.00 | XXXX | 6637 |
| HETATM | 6638 | O | HOH S | 792 | 10.419 | 65.451 | 33.731 | 1.00 | 0.00 | XXXX | 6638 |
| HETATM | 6639 | O | HOH S | 793 | 24.969 | 49.879 | 75.788 | 1.00 | 0.00 | XXXX | 6639 |
| HETATM | 6640 | O | HOH S | 794 | 39.469 | 43.399 | 49.030 | 1.00 | 0.00 | XXXX | 6640 |
| HETATM | 6641 | O | HOH S | 795 | −24.132 | 27.795 | 59.065 | 1.00 | 0.00 | XXXX | 6641 |
| HETATM | 6642 | O | HOH S | 796 | 10.585 | 66.256 | 30.838 | 1.00 | 0.00 | XXXX | 6642 |
| HETATM | 6643 | O | HOH S | 797 | 6.923 | 37.692 | 72.710 | 1.00 | 0.00 | XXXX | 6643 |
| HETATM | 6644 | O | HOH S | 798 | 23.397 | 33.970 | 28.832 | 1.00 | 0.00 | XXXX | 6644 |
| HETATM | 6645 | O | HOH S | 799 | 15.631 | 22.185 | 41.290 | 1.00 | 0.00 | XXXX | 6645 |
| HETATM | 6646 | O | HOH S | 800 | 5.363 | 65.746 | 22.559 | 1.00 | 0.00 | XXXX | 6646 |
| HETATM | 6647 | O | HOH S | 801 | 10.829 | 46.043 | 34.923 | 1.00 | 0.00 | XXXX | 6647 |
| HETATM | 6648 | O | HOH S | 802 | −6.078 | 60.707 | 51.322 | 1.00 | 0.00 | XXXX | 6648 |
| HETATM | 6649 | O | HOH S | 803 | 16.614 | 67.920 | 44.228 | 1.00 | 0.00 | XXXX | 6649 |
| HETATM | 6650 | O | HOH S | 804 | −25.810 | 60.388 | 36.781 | 1.00 | 0.00 | XXXX | 6650 |
| HETATM | 6651 | O | HOH S | 805 | −1.701 | 70.140 | 48.105 | 1.00 | 0.00 | XXXX | 6651 |
| HETATM | 6652 | O | HOH S | 806 | −1.134 | 75.556 | 53.152 | 1.00 | 0.00 | XXXX | 6652 |
| HETATM | 6653 | O | HOH S | 807 | 24.188 | 45.902 | 73.602 | 1.00 | 0.00 | XXXX | 6653 |
| HETATM | 6654 | O | HOH S | 808 | −30.132 | 27.973 | 25.335 | 1.00 | 0.00 | XXXX | 6654 |
| HETATM | 6655 | O | HOH S | 809 | 19.043 | 65.533 | 41.093 | 1.00 | 0.00 | XXXX | 6655 |
| HETATM | 6656 | O | HOH S | 810 | 13.097 | 41.489 | 76.504 | 1.00 | 0.00 | XXXX | 6656 |
| HETATM | 6657 | O | HOH S | 811 | 7.767 | 76.289 | 52.275 | 1.00 | 0.00 | XXXX | 6657 |
| HETATM | 6658 | O | HOH S | 812 | −7.386 | 26.367 | 50.016 | 1.00 | 0.00 | XXXX | 6658 |
| HETATM | 6659 | O | HOH S | 813 | −10.961 | 65.366 | 52.185 | 1.00 | 0.00 | XXXX | 6659 |
| HETATM | 6660 | O | HOH S | 814 | −7.274 | 27.914 | 33.425 | 1.00 | 0.00 | XXXX | 6660 |
| HETATM | 6661 | O | HOH S | 815 | 17.131 | 48.782 | 33.387 | 1.00 | 0.00 | XXXX | 6661 |
| HETATM | 6662 | O | HOH S | 816 | 5.845 | 70.445 | 73.607 | 1.00 | 0.00 | XXXX | 6662 |
| HETATM | 6663 | O | HOH S | 817 | 22.154 | 61.981 | 70.044 | 1.00 | 0.00 | XXXX | 6663 |
| HETATM | 6664 | O | HOH S | 818 | −0.817 | 29.748 | 22.132 | 1.00 | 0.00 | XXXX | 6664 |
| HETATM | 6665 | O | HOH S | 819 | −2.377 | 73.909 | 54.257 | 1.00 | 0.00 | XXXX | 6665 |
| HETATM | 6666 | O | HOH S | 820 | −13.975 | 57.751 | 51.413 | 1.00 | 0.00 | XXXX | 6666 |
| HETATM | 6667 | O | HOH S | 821 | 17.891 | 67.085 | 42.361 | 1.00 | 0.00 | XXXX | 6667 |
| HETATM | 6668 | O | HOH S | 822 | 13.302 | 47.106 | 34.954 | 1.00 | 0.00 | XXXX | 6668 |
| HETATM | 6669 | O | HOH S | 823 | 29.463 | 27.781 | 65.145 | 1.00 | 0.00 | XXXX | 6669 |
| HETATM | 6670 | O | HOH S | 824 | −23.897 | 60.488 | 40.038 | 1.00 | 0.00 | XXXX | 6670 |
| HETATM | 6671 | O | HOH S | 825 | −33.635 | 28.181 | 44.735 | 1.00 | 0.00 | XXXX | 6671 |
| HETATM | 6672 | O | HOH S | 826 | 8.365 | 32.492 | 71.456 | 1.00 | 0.00 | XXXX | 6672 |
| HETATM | 6673 | O | HOH S | 827 | 22.236 | 27.280 | 65.405 | 1.00 | 0.00 | XXXX | 6673 |
| HETATM | 6674 | O | HOH S | 828 | 21.195 | 66.157 | 55.327 | 1.00 | 0.00 | XXXX | 6674 |
| HETATM | 6675 | O | HOH S | 829 | 26.794 | 59.304 | 49.705 | 1.00 | 0.00 | XXXX | 6675 |
| HETATM | 6676 | O | HOH S | 830 | 37.031 | 51.621 | 57.177 | 1.00 | 0.00 | XXXX | 6676 |
| HETATM | 6677 | O | HOH S | 831 | 37.803 | 54.193 | 56.138 | 1.00 | 0.00 | XXXX | 6677 |
| HETATM | 6678 | O | HOH S | 832 | 3.557 | 76.334 | 47.673 | 1.00 | 0.00 | XXXX | 6678 |
| HETATM | 6679 | O | HOH S | 833 | −27.270 | 56.609 | 46.541 | 1.00 | 0.00 | XXXX | 6679 |
| HETATM | 6680 | O | HOH S | 834 | −40.136 | 56.196 | 26.580 | 1.00 | 0.00 | XXXX | 6680 |
| HETATM | 6681 | O | HOH S | 835 | −23.935 | 61.760 | 24.721 | 1.00 | 0.00 | XXXX | 6681 |
| HETATM | 6682 | O | HOH S | 836 | −8.403 | 46.003 | 9.825 | 1.00 | 0.00 | XXXX | 6682 |
| HETATM | 6683 | O | HOH S | 837 | −4.193 | 65.973 | 76.624 | 1.00 | 0.00 | XXXX | 6683 |
| HETATM | 6684 | O | HOH S | 838 | −20.341 | 27.916 | 58.768 | 1.00 | 0.00 | XXXX | 6684 |
| HETATM | 6685 | O | HOH S | 839 | −36.616 | 52.070 | 34.629 | 1.00 | 0.00 | XXXX | 6685 |
| HETATM | 6686 | O | HOH S | 840 | −35.854 | 26.640 | 38.868 | 1.00 | 0.00 | XXXX | 6686 |
| HETATM | 6687 | O | HOH S | 841 | 0.477 | 67.267 | 14.347 | 1.00 | 0.00 | XXXX | 6687 |
| HETATM | 6688 | O | HOH S | 842 | −29.466 | 45.855 | 52.906 | 1.00 | 0.00 | XXXX | 6688 |

-continued

| | | | | | | | | | | |
|---|---|---|---|---|---|---|---|---|---|---|
| HETATM | 6689 | O | HOH S | 843 | −23.533 | 38.456 | 18.984 | 1.00 | 0.00 | XXXX | 6689 |
| HETATM | 6690 | O | HOH S | 844 | −39.064 | 48.377 | 40.823 | 1.00 | 0.00 | XXXX | 6690 |
| HETATM | 6691 | O | HOH S | 845 | −24.919 | 37.212 | 21.047 | 1.00 | 0.00 | XXXX | 6691 |
| HETATM | 6692 | O | HOH S | 846 | −37.377 | 44.458 | 48.447 | 1.00 | 0.00 | XXXX | 6692 |
| HETATM | 6693 | O | HOH S | 847 | −1.291 | 66.136 | 46.268 | 1.00 | 0.00 | XXXX | 6693 |
| HETATM | 6694 | O | HOH S | 848 | 10.719 | 18.407 | 42.906 | 1.00 | 0.00 | XXXX | 6694 |
| HETATM | 6695 | O | HOH S | 849 | 9.875 | 18.160 | 45.008 | 1.00 | 0.00 | XXXX | 6695 |
| HETATM | 6696 | O | HOH S | 850 | 14.325 | 69.036 | 67.922 | 1.00 | 0.00 | XXXX | 6696 |
| HETATM | 6697 | O | HOH S | 851 | 21.780 | 24.432 | 45.230 | 1.00 | 0.00 | XXXX | 6697 |
| HETATM | 6698 | O | HOH S | 852 | 24.481 | 62.718 | 70.733 | 1.00 | 0.00 | XXXX | 6698 |
| HETATM | 6699 | O | HOH S | 853 | 2.511 | 61.835 | 13.698 | 1.00 | 0.00 | XXXX | 6699 |
| HETATM | 6700 | O | HOH S | 854 | 11.276 | 19.485 | 45.547 | 1.00 | 0.00 | XXXX | 6700 |
| HETATM | 6701 | O | HOH S | 855 | 14.941 | 52.513 | 37.842 | 1.00 | 0.00 | XXXX | 6701 |
| HETATM | 6702 | O | HOH S | 856 | −28.952 | 47.891 | 53.264 | 1.00 | 0.00 | XXXX | 6702 |
| HETATM | 6703 | O | HOH S | 857 | −37.802 | 49.883 | 41.183 | 1.00 | 0.00 | XXXX | 6703 |
| HETATM | 6704 | O | HOH S | 858 | 31.839 | 27.999 | 65.008 | 1.00 | 0.00 | XXXX | 6704 |
| HETATM | 6705 | O | HOH S | 859 | 32.537 | 30.222 | 44.037 | 1.00 | 0.00 | XXXX | 6705 |
| HETATM | 6706 | O | HOH S | 860 | 27.736 | 56.836 | 54.826 | 1.00 | 0.00 | XXXX | 6706 |
| HETATM | 6707 | O | HOH S | 861 | −31.372 | 26.820 | 36.721 | 1.00 | 0.00 | XXXX | 6707 |
| HETATM | 6708 | O | HOH S | 862 | 20.583 | 64.365 | 70.499 | 1.00 | 0.00 | XXXX | 6708 |
| HETATM | 6709 | O | HOH S | 863 | −6.187 | 63.770 | 51.047 | 1.00 | 0.00 | XXXX | 6709 |
| HETATM | 6710 | O | HOH S | 864 | 14.063 | 27.675 | 36.573 | 1.00 | 0.00 | XXXX | 6710 |
| HETATM | 6711 | O | HOH S | 865 | 1.504 | 44.769 | 47.220 | 1.00 | 0.00 | XXXX | 6711 |
| HETATM | 6712 | O | HOH S | 866 | 33.962 | 60.259 | 66.696 | 1.00 | 0.00 | XXXX | 6712 |
| HETATM | 6713 | O | HOH S | 867 | 28.598 | 47.263 | 34.145 | 1.00 | 0.00 | XXXX | 6713 |
| HETATM | 6714 | O | HOH S | 868 | −29.551 | 57.177 | 34.357 | 1.00 | 0.00 | XXXX | 6714 |
| HETATM | 6715 | O | HOH S | 869 | −19.167 | 61.255 | 46.315 | 1.00 | 0.00 | XXXX | 6715 |
| HETATM | 6716 | O | HOH S | 870 | −6.386 | 25.058 | 43.539 | 1.00 | 0.00 | XXXX | 6716 |
| HETATM | 6717 | O | HOH S | 871 | −10.360 | 50.700 | 11.946 | 1.00 | 0.00 | XXXX | 6717 |
| HETATM | 6718 | O | HOH S | 872 | −3.933 | 67.533 | 45.799 | 1.00 | 0.00 | XXXX | 6718 |
| HETATM | 6719 | O | HOH S | 873 | 33.390 | 47.485 | 37.497 | 1.00 | 0.00 | XXXX | 6719 |
| HETATM | 6720 | O | HOH S | 874 | 26.578 | 42.688 | 32.283 | 1.00 | 0.00 | XXXX | 6720 |
| HETATM | 6721 | O | HOH S | 875 | −26.419 | 61.610 | 28.906 | 1.00 | 0.00 | XXXX | 6721 |
| HETATM | 6722 | O | HOH S | 876 | −42.642 | 42.743 | 34.833 | 1.00 | 0.00 | XXXX | 6722 |
| HETATM | 6723 | O | HOH S | 877 | −4.920 | 64.636 | 75.304 | 1.00 | 0.00 | XXXX | 6723 |
| HETATM | 6724 | O | HOH S | 878 | 7.885 | 66.715 | 31.259 | 1.00 | 0.00 | XXXX | 6724 |
| HETATM | 6725 | O | HOH S | 879 | −27.222 | 28.290 | 27.390 | 1.00 | 0.00 | XXXX | 6725 |
| HETATM | 6726 | O | HOH S | 880 | −15.175 | 56.349 | 68.631 | 1.00 | 0.00 | XXXX | 6726 |
| HETATM | 6727 | O | HOH S | 881 | −31.610 | 26.388 | 45.609 | 1.00 | 0.00 | XXXX | 6727 |
| HETATM | 6728 | O | HOH S | 882 | 19.762 | 69.242 | 52.533 | 1.00 | 0.00 | XXXX | 6728 |
| HETATM | 6729 | O | HOH S | 883 | −13.131 | 63.650 | 68.734 | 1.00 | 0.00 | XXXX | 6729 |
| HETATM | 6730 | O | HOH S | 884 | 28.257 | 26.740 | 62.595 | 1.00 | 0.00 | XXXX | 6730 |
| HETATM | 6731 | O | HOH S | 885 | 33.441 | 49.644 | 42.016 | 1.00 | 0.00 | XXXX | 6731 |
| HETATM | 6732 | O | HOH S | 886 | 17.899 | 26.481 | 65.487 | 1.00 | 0.00 | XXXX | 6732 |
| HETATM | 6733 | O | HOH S | 887 | 1.875 | 69.824 | 22.081 | 1.00 | 0.00 | XXXX | 6733 |
| HETATM | 6734 | O | HOH S | 888 | −13.248 | 53.548 | 61.667 | 1.00 | 0.00 | XXXX | 6734 |
| HETATM | 6735 | O | HOH S | 889 | 17.957 | 29.370 | 68.066 | 1.00 | 0.00 | XXXX | 6735 |
| HETATM | 6736 | O | HOH S | 890 | −18.979 | 63.344 | 45.891 | 1.00 | 0.00 | XXXX | 6736 |
| HETATM | 6737 | O | HOH S | 891 | 20.725 | 67.520 | 53.781 | 1.00 | 0.00 | XXXX | 6737 |
| HETATM | 6738 | O | HOH S | 892 | −22.605 | 25.999 | 57.298 | 1.00 | 0.00 | XXXX | 6738 |
| HETATM | 6739 | O | HOH S | 893 | −36.626 | 50.950 | 42.996 | 1.00 | 0.00 | XXXX | 6739 |
| HETATM | 6740 | O | HOH S | 894 | −29.638 | 55.344 | 50.345 | 1.00 | 0.00 | XXXX | 6740 |
| HETATM | 6741 | O | HOH S | 895 | 30.129 | 50.586 | 39.132 | 1.00 | 0.00 | XXXX | 6741 |
| HETATM | 6742 | O | HOH S | 896 | −31.330 | 55.813 | 35.254 | 1.00 | 0.00 | XXXX | 6742 |
| HETATM | 6743 | O | HOH S | 897 | 13.507 | 62.834 | 37.640 | 1.00 | 0.00 | XXXX | 6743 |
| HETATM | 6744 | O | HOH S | 898 | −28.307 | 29.299 | 25.946 | 1.00 | 0.00 | XXXX | 6744 |
| HETATM | 6745 | O | HOH S | 899 | 10.293 | 43.017 | 37.880 | 1.00 | 0.00 | XXXX | 6745 |
| HETATM | 6746 | O | HOH S | 900 | 4.490 | 39.008 | 43.859 | 1.00 | 0.00 | XXXX | 6746 |
| HETATM | 6747 | O | HOH S | 901 | 20.201 | 29.887 | 67.386 | 1.00 | 0.00 | XXXX | 6747 |
| HETATM | 6748 | O | HOH S | 902 | −0.828 | 64.410 | 79.218 | 1.00 | 0.00 | XXXX | 6748 |
| HETATM | 6749 | O | HOH S | 903 | 19.254 | 27.900 | 44.059 | 1.00 | 0.00 | XXXX | 6749 |
| HETATM | 6750 | O | HOH S | 904 | 11.741 | 49.010 | 37.539 | 1.00 | 0.00 | XXXX | 6750 |
| HETATM | 6751 | O | HOH S | 905 | 4.033 | 63.279 | 11.977 | 1.00 | 0.00 | XXXX | 6751 |
| HETATM | 6752 | O | HOH S | 906 | 28.328 | 60.144 | 51.530 | 1.00 | 0.00 | XXXX | 6752 |
| HETATM | 6753 | O | HOH S | 907 | 0.614 | 62.975 | 79.686 | 1.00 | 0.00 | XXXX | 6753 |
| HETATM | 6754 | O | HOH S | 908 | 31.078 | 29.716 | 40.300 | 1.00 | 0.00 | XXXX | 6754 |
| HETATM | 6755 | O | HOH S | 909 | 21.386 | 35.514 | 29.086 | 1.00 | 0.00 | XXXX | 6755 |
| HETATM | 6756 | O | HOH S | 910 | 27.565 | 33.818 | 65.358 | 1.00 | 0.00 | XXXX | 6756 |
| HETATM | 6757 | O | HOH S | 911 | −9.301 | 29.451 | 20.142 | 1.00 | 0.00 | XXXX | 6757 |
| HETATM | 6758 | O | HOH S | 912 | 5.919 | 37.428 | 70.756 | 1.00 | 0.00 | XXXX | 6758 |
| HETATM | 6759 | O | HOH S | 913 | −13.611 | 46.456 | 64.400 | 1.00 | 0.00 | XXXX | 6759 |
| HETATM | 6760 | O | HOH S | 914 | 21.288 | 25.617 | 62.274 | 1.00 | 0.00 | XXXX | 6760 |
| HETATM | 6761 | O | HOH S | 915 | 5.201 | 29.643 | 47.094 | 1.00 | 0.00 | XXXX | 6761 |
| HETATM | 6762 | O | HOH S | 916 | −14.565 | 48.843 | 55.393 | 1.00 | 0.00 | XXXX | 6762 |
| HETATM | 6763 | O | HOH S | 917 | −23.340 | 34.202 | 61.787 | 1.00 | 0.00 | XXXX | 6763 |
| HETATM | 6764 | O | HOH S | 918 | −31.196 | 56.444 | 20.319 | 1.00 | 0.00 | XXXX | 6764 |
| HETATM | 6765 | O | HOH S | 919 | −6.028 | 24.562 | 50.755 | 1.00 | 0.00 | XXXX | 6765 |
| HETATM | 6766 | O | HOH S | 920 | −33.295 | 49.228 | 48.787 | 1.00 | 0.00 | XXXX | 6766 |
| HETATM | 6767 | O | HOH S | 921 | −12.864 | 68.038 | 45.376 | 1.00 | 0.00 | XXXX | 6767 |

-continued

| | | | | | | | | | | |
|---|---|---|---|---|---|---|---|---|---|---|
| HETATM | 6768 | O | HOH S | 922 | 20.163 | 24.249 | 61.253 | 1.00 | 0.00 | XXXX | 6768 |
| HETATM | 6769 | O | HOH S | 923 | 21.512 | 65.453 | 64.084 | 1.00 | 0.00 | XXXX | 6769 |
| HETATM | 6770 | O | HOH S | 924 | −24.100 | 64.908 | 26.944 | 1.00 | 0.00 | XXXX | 6770 |
| HETATM | 6771 | O | HOH S | 925 | 32.638 | 29.452 | 41.941 | 1.00 | 0.00 | XXXX | 6771 |
| HETATM | 6772 | O | HOH S | 926 | −8.768 | 65.109 | 53.969 | 1.00 | 0.00 | XXXX | 6772 |
| HETATM | 6773 | O | HOH S | 927 | −11.845 | 56.296 | 59.354 | 1.00 | 0.00 | XXXX | 6773 |
| HETATM | 6774 | O | HOH S | 928 | −29.444 | 57.764 | 22.344 | 1.00 | 0.00 | XXXX | 6774 |
| HETATM | 6775 | O | HOH S | 929 | 3.252 | 27.036 | 67.955 | 1.00 | 0.00 | XXXX | 6775 |
| HETATM | 6776 | O | HOH S | 930 | −13.118 | 45.189 | 62.531 | 1.00 | 0.00 | XXXX | 6776 |
| HETATM | 6777 | O | HOH S | 931 | −3.960 | 66.888 | 72.056 | 1.00 | 0.00 | XXXX | 6777 |
| HETATM | 6778 | O | HOH S | 932 | −7.090 | 70.010 | 16.108 | 1.00 | 0.00 | XXXX | 6778 |
| HETATM | 6779 | O | HOH S | 933 | 9.752 | 72.831 | 47.677 | 1.00 | 0.00 | XXXX | 6779 |
| HETATM | 6780 | O | HOH S | 934 | 23.012 | 30.523 | 69.927 | 1.00 | 0.00 | XXXX | 6780 |
| HETATM | 6781 | O | HOH S | 935 | −9.722 | 29.588 | 22.728 | 1.00 | 0.00 | XXXX | 6781 |
| HETATM | 6782 | O | HOH S | 936 | −12.262 | 33.545 | 18.741 | 1.00 | 0.00 | XXXX | 6782 |
| HETATM | 6783 | O | HOH S | 937 | 21.596 | 66.205 | 61.776 | 1.00 | 0.00 | XXXX | 6783 |
| HETATM | 6784 | O | HOH S | 938 | −20.640 | 25.466 | 28.217 | 1.00 | 0.00 | XXXX | 6784 |
| HETATM | 6785 | O | HOH S | 939 | −42.734 | 55.487 | 26.210 | 1.00 | 0.00 | XXXX | 6785 |
| HETATM | 6786 | O | HOH S | 940 | 23.520 | 26.375 | 59.599 | 1.00 | 0.00 | XXXX | 6786 |
| HETATM | 6787 | O | HOH S | 941 | 26.978 | 43.200 | 35.666 | 1.00 | 0.00 | XXXX | 6787 |
| HETATM | 6788 | O | HOH S | 942 | −14.717 | 43.692 | 53.650 | 1.00 | 0.00 | XXXX | 6788 |
| HETATM | 6789 | O | HOH S | 943 | −3.090 | 68.407 | 27.290 | 1.00 | 0.00 | XXXX | 6789 |
| HETATM | 6790 | O | HOH S | 944 | 5.583 | 44.175 | 24.838 | 1.00 | 0.00 | XXXX | 6790 |
| HETATM | 6791 | O | HOH S | 945 | 24.577 | 41.168 | 67.535 | 1.00 | 0.00 | XXXX | 6791 |
| HETATM | 6792 | O | HOH S | 946 | −11.491 | 68.412 | 65.369 | 1.00 | 0.00 | XXXX | 6792 |
| HETATM | 6793 | O | HOH S | 947 | −14.022 | 41.780 | 55.558 | 1.00 | 0.00 | XXXX | 6793 |
| HETATM | 6794 | O | HOH S | 948 | −1.563 | 68.725 | 13.890 | 1.00 | 0.00 | XXXX | 6794 |
| HETATM | 6795 | O | HOH S | 949 | 29.379 | 46.776 | 38.197 | 1.00 | 0.00 | XXXX | 6795 |
| HETATM | 6796 | O | HOH S | 950 | −20.146 | 56.293 | 47.854 | 1.00 | 0.00 | XXXX | 6796 |
| HETATM | 6797 | O | HOH S | 951 | 13.395 | 67.707 | 46.029 | 1.00 | 0.00 | XXXX | 6797 |
| HETATM | 6798 | O | HOH S | 952 | 13.837 | 57.844 | 39.369 | 1.00 | 0.00 | XXXX | 6798 |
| HETATM | 6799 | O | HOH S | 953 | −2.425 | 66.932 | 25.988 | 1.00 | 0.00 | XXXX | 6799 |
| HETATM | 6800 | O | HOH S | 954 | −14.119 | 22.583 | 34.581 | 1.00 | 0.00 | XXXX | 6800 |
| HETATM | 6801 | O | HOH S | 955 | 25.764 | 25.505 | 58.850 | 1.00 | 0.00 | XXXX | 6801 |
| HETATM | 6802 | O | HOH S | 956 | 26.043 | 26.523 | 50.465 | 1.00 | 0.00 | XXXX | 6802 |
| HETATM | 6803 | O | HOH S | 957 | −15.316 | 36.349 | 19.271 | 1.00 | 0.00 | XXXX | 6803 |
| HETATM | 6804 | O | HOH S | 958 | 38.842 | 51.736 | 49.240 | 1.00 | 0.00 | XXXX | 6804 |
| HETATM | 6805 | O | HOH S | 959 | −18.829 | 40.265 | 10.903 | 1.00 | 0.00 | XXXX | 6805 |
| HETATM | 6806 | O | HOH S | 960 | 20.193 | 53.354 | 78.650 | 1.00 | 0.00 | XXXX | 6806 |
| HETATM | 6807 | O | HOH S | 961 | −35.856 | 29.703 | 30.038 | 1.00 | 0.00 | XXXX | 6807 |
| HETATM | 6808 | O | HOH S | 962 | −5.977 | 45.169 | 12.980 | 1.00 | 0.00 | XXXX | 6808 |
| HETATM | 6809 | O | HOH S | 963 | −1.814 | 30.536 | 53.580 | 1.00 | 0.00 | XXXX | 6809 |
| HETATM | 6810 | O | HOH S | 964 | 19.790 | 17.897 | 48.238 | 1.00 | 0.00 | XXXX | 6810 |
| HETATM | 6811 | O | HOH S | 965 | 34.144 | 55.354 | 48.367 | 1.00 | 0.00 | XXXX | 6811 |
| HETATM | 6812 | O | HOH S | 966 | 12.495 | 64.259 | 20.978 | 1.00 | 0.00 | XXXX | 6812 |
| HETATM | 6813 | O | HOH S | 967 | 32.189 | 54.666 | 51.696 | 1.00 | 0.00 | XXXX | 6813 |
| HETATM | 6814 | O | HOH S | 968 | 21.345 | 68.534 | 70.885 | 1.00 | 0.00 | XXXX | 6814 |
| HETATM | 6815 | O | HOH S | 969 | 5.465 | 66.546 | 24.582 | 1.00 | 0.00 | XXXX | 6815 |
| HETATM | 6816 | O | HOH S | 970 | −13.028 | 65.416 | 58.829 | 1.00 | 0.00 | XXXX | 6816 |
| HETATM | 6817 | O | HOH S | 971 | 18.469 | 34.890 | 32.195 | 1.00 | 0.00 | XXXX | 6817 |
| HETATM | 6818 | O | HOH S | 972 | −4.767 | 69.356 | 55.849 | 1.00 | 0.00 | XXXX | 6818 |
| HETATM | 6819 | O | HOH S | 973 | 0.560 | 69.696 | 15.646 | 1.00 | 0.00 | XXXX | 6819 |
| HETATM | 6820 | O | HOH S | 974 | 0.281 | 30.357 | 52.499 | 1.00 | 0.00 | XXXX | 6820 |
| HETATM | 6821 | O | HOH S | 975 | 11.404 | 65.072 | 38.409 | 1.00 | 0.00 | XXXX | 6821 |
| HETATM | 6822 | O | HOH S | 976 | 29.895 | 55.136 | 51.484 | 1.00 | 0.00 | XXXX | 6822 |
| HETATM | 6823 | O | HOH S | 977 | −28.777 | 46.509 | 56.933 | 1.00 | 0.00 | XXXX | 6823 |
| HETATM | 6824 | O | HOH S | 978 | −7.676 | 24.679 | 36.551 | 1.00 | 0.00 | XXXX | 6824 |
| HETATM | 6825 | O | HOH S | 979 | −8.051 | 40.707 | 50.082 | 1.00 | 0.00 | XXXX | 6825 |
| HETATM | 6826 | O | HOH S | 980 | −17.967 | 55.388 | 49.956 | 1.00 | 0.00 | XXXX | 6826 |
| HETATM | 6827 | O | HOH S | 981 | 34.870 | 51.037 | 70.223 | 1.00 | 0.00 | XXXX | 6827 |
| HETATM | 6828 | O | HOH S | 982 | 32.506 | 55.158 | 49.601 | 1.00 | 0.00 | XXXX | 6828 |
| HETATM | 6829 | O | HOH S | 983 | 23.700 | 62.354 | 56.270 | 1.00 | 0.00 | XXXX | 6829 |
| HETATM | 6830 | O | HOH S | 984 | 19.627 | 51.697 | 35.799 | 1.00 | 0.00 | XXXX | 6830 |
| HETATM | 6831 | O | HOH S | 985 | −22.795 | 59.790 | 12.087 | 1.00 | 0.00 | XXXX | 6831 |
| HETATM | 6832 | O | HOH S | 986 | 5.552 | 30.742 | 30.976 | 1.00 | 0.00 | XXXX | 6832 |
| HETATM | 6833 | O | HOH S | 987 | −10.607 | 65.401 | 57.239 | 1.00 | 0.00 | XXXX | 6833 |
| HETATM | 6834 | O | HOH S | 988 | −30.903 | 57.981 | 24.450 | 1.00 | 0.00 | XXXX | 6834 |
| HETATM | 6835 | O | HOH S | 989 | −16.064 | 22.776 | 36.045 | 1.00 | 0.00 | XXXX | 6835 |
| HETATM | 6836 | O | HOH S | 990 | 28.353 | 45.765 | 36.282 | 1.00 | 0.00 | XXXX | 6836 |
| HETATM | 6837 | O | HOH S | 991 | −34.166 | 55.196 | 43.455 | 1.00 | 0.00 | XXXX | 6837 |
| HETATM | 6838 | O | HOH S | 992 | −11.827 | 57.308 | 72.407 | 1.00 | 0.00 | XXXX | 6838 |
| HETATM | 6839 | O | HOH S | 993 | −21.653 | 38.763 | 62.737 | 1.00 | 0.00 | XXXX | 6839 |
| HETATM | 6840 | O | HOH S | 994 | −0.296 | 64.008 | 45.692 | 1.00 | 0.00 | XXXX | 6840 |
| HETATM | 6841 | O | HOH S | 995 | 38.569 | 43.668 | 42.152 | 1.00 | 0.00 | XXXX | 6841 |
| HETATM | 6842 | O | HOH S | 996 | −10.046 | 68.104 | 62.957 | 1.00 | 0.00 | XXXX | 6842 |
| HETATM | 6843 | O | HOH S | 997 | 19.056 | 49.212 | 32.709 | 1.00 | 0.00 | XXXX | 6843 |
| HETATM | 6844 | O | HOH S | 998 | −27.009 | 33.650 | 25.830 | 1.00 | 0.00 | XXXX | 6844 |
| HETATM | 6845 | O | HOH S | 999 | 7.807 | 43.869 | 25.780 | 1.00 | 0.00 | XXXX | 6845 |
| HETATM | 6846 | O | HOH S | 1000 | −8.901 | 64.020 | 50.307 | 1.00 | 0.00 | XXXX | 6846 |

-continued

| | | | | | | | | | | |
|---|---|---|---|---|---|---|---|---|---|---|
| HETATM | 6847 | O | HOH | S | 1001 | −32.720 | 51.820 | 49.096 | 1.00 | 0.00 XXXX 6847 |
| HETATM | 6848 | O | HOH | S | 1002 | 24.558 | 52.096 | 75.118 | 1.00 | 0.00 XXXX 6848 |
| HETATM | 6849 | O | HOH | S | 1003 | 19.044 | 23.304 | 47.687 | 1.00 | 0.00 XXXX 6849 |
| HETATM | 6850 | O | HOH | S | 1004 | −20.867 | 42.883 | 16.441 | 1.00 | 0.00 XXXX 6850 |
| HETATM | 6851 | O | HOH | S | 1005 | −17.606 | 47.900 | 59.117 | 1.00 | 0.00 XXXX 6851 |
| HETATM | 6852 | O | HOH | S | 1006 | 21.125 | 58.402 | 40.637 | 1.00 | 0.00 XXXX 6852 |
| HETATM | 6853 | O | HOH | S | 1007 | 11.253 | 62.165 | 37.657 | 1.00 | 0.00 XXXX 6853 |
| HETATM | 6854 | O | HOH | S | 1008 | 29.319 | 48.408 | 37.239 | 1.00 | 0.00 XXXX 6854 |
| HETATM | 6855 | O | HOH | S | 1009 | −29.395 | 61.128 | 25.439 | 1.00 | 0.00 XXXX 6855 |
| HETATM | 6856 | O | HOH | S | 1010 | 36.767 | 50.827 | 47.958 | 1.00 | 0.00 XXXX 6856 |
| HETATM | 6857 | O | HOH | S | 1011 | −28.071 | 59.425 | 31.480 | 1.00 | 0.00 XXXX 6857 |
| HETATM | 6858 | O | HOH | S | 1012 | 10.026 | 33.895 | 68.317 | 1.00 | 0.00 XXXX 6858 |
| HETATM | 6859 | O | HOH | S | 1013 | −10.535 | 38.988 | 13.104 | 1.00 | 0.00 XXXX 6859 |
| HETATM | 6860 | O | HOH | S | 1014 | −44.354 | 57.320 | 25.738 | 1.00 | 0.00 XXXX 6860 |
| HETATM | 6861 | O | HOH | S | 1015 | 37.906 | 29.684 | 47.815 | 1.00 | 0.00 XXXX 6861 |
| HETATM | 6862 | O | HOH | S | 1016 | 10.397 | 36.496 | 74.537 | 1.00 | 0.00 XXXX 6862 |
| HETATM | 6863 | O | HOH | S | 1017 | 0.206 | 76.782 | 55.121 | 1.00 | 0.00 XXXX 6863 |
| HETATM | 6864 | O | HOH | S | 1018 | −36.492 | 46.976 | 50.938 | 1.00 | 0.00 XXXX 6864 |
| HETATM | 6865 | O | HOH | S | 1019 | 11.021 | 24.925 | 40.808 | 1.00 | 0.00 XXXX 6865 |
| HETATM | 6866 | O | HOH | S | 1020 | 31.661 | 26.756 | 54.291 | 1.00 | 0.00 XXXX 6866 |
| HETATM | 6867 | O | HOH | S | 1021 | −23.520 | 55.061 | 51.378 | 1.00 | 0.00 XXXX 6867 |
| HETATM | 6868 | O | HOH | S | 1022 | −12.628 | 40.385 | 14.213 | 1.00 | 0.00 XXXX 6868 |
| HETATM | 6869 | O | HOH | S | 1023 | −32.009 | 56.271 | 45.501 | 1.00 | 0.00 XXXX 6869 |
| HETATM | 6870 | O | HOH | S | 1024 | 22.542 | 26.340 | 55.016 | 1.00 | 0.00 XXXX 6870 |
| HETATM | 6871 | O | HOH | S | 1025 | −2.770 | 31.387 | 32.890 | 1.00 | 0.00 XXXX 6871 |
| HETATM | 6872 | O | HOH | S | 1026 | −26.522 | 28.773 | 35.903 | 1.00 | 0.00 XXXX 6872 |
| HETATM | 6873 | O | HOH | S | 1027 | −42.767 | 50.323 | 29.541 | 1.00 | 0.00 XXXX 6873 |
| HETATM | 6874 | O | HOH | S | 1028 | −41.201 | 53.032 | 29.570 | 1.00 | 0.00 XXXX 6874 |
| HETATM | 6875 | O | HOH | S | 1029 | 17.767 | 63.319 | 46.777 | 1.00 | 0.00 XXXX 6875 |
| HETATM | 6876 | O | HOH | S | 1030 | 7.050 | 43.249 | 75.581 | 1.00 | 0.00 XXXX 6876 |
| HETATM | 6877 | O | HOH | S | 1031 | 38.724 | 28.635 | 44.734 | 1.00 | 0.00 XXXX 6877 |
| HETATM | 6878 | O | HOH | S | 1032 | −13.191 | 71.446 | 36.920 | 1.00 | 0.00 XXXX 6878 |
| HETATM | 6879 | O | HOH | S | 1033 | 16.376 | 65.640 | 27.715 | 1.00 | 0.00 XXXX 6879 |
| HETATM | 6880 | O | HOH | S | 1034 | 14.787 | 47.607 | 36.755 | 1.00 | 0.00 XXXX 6880 |
| HETATM | 6881 | O | HOH | S | 1035 | 8.194 | 44.673 | 74.584 | 1.00 | 0.00 XXXX 6881 |
| HETATM | 6882 | O | HOH | S | 1036 | −9.186 | 55.111 | 56.517 | 1.00 | 0.00 XXXX 6882 |
| HETATM | 6883 | O | HOH | S | 1037 | 19.260 | 63.223 | 45.010 | 1.00 | 0.00 XXXX 6883 |
| HETATM | 6884 | O | HOH | S | 1038 | −13.786 | 29.019 | 55.336 | 1.00 | 0.00 XXXX 6884 |
| HETATM | 6885 | O | HOH | S | 1039 | 40.228 | 29.212 | 46.245 | 1.00 | 0.00 XXXX 6885 |
| HETATM | 6886 | O | HOH | S | 1040 | 21.339 | 26.952 | 52.392 | 1.00 | 0.00 XXXX 6886 |
| HETATM | 6887 | O | HOH | S | 1041 | −1.982 | 71.555 | 18.696 | 1.00 | 0.00 XXXX 6887 |
| HETATM | 6888 | O | HOH | S | 1042 | 10.061 | 44.977 | 75.397 | 1.00 | 0.00 XXXX 6888 |
| HETATM | 6889 | O | HOH | S | 1043 | 15.915 | 65.590 | 30.418 | 1.00 | 0.00 XXXX 6889 |
| HETATM | 6890 | O | HOH | S | 1044 | −3.479 | 67.467 | 12.554 | 1.00 | 0.00 XXXX 6890 |
| HETATM | 6891 | O | HOH | S | 1045 | 25.005 | 61.744 | 37.778 | 1.00 | 0.00 XXXX 6891 |
| HETATM | 6892 | O | HOH | S | 1046 | −24.467 | 47.130 | 16.957 | 1.00 | 0.00 XXXX 6892 |
| HETATM | 6893 | O | HOH | S | 1047 | −37.949 | 53.961 | 34.527 | 1.00 | 0.00 XXXX 6893 |
| HETATM | 6894 | O | HOH | S | 1048 | 25.573 | 57.854 | 74.013 | 1.00 | 0.00 XXXX 6894 |
| HETATM | 6895 | O | HOH | S | 1049 | −26.778 | 28.090 | 33.740 | 1.00 | 0.00 XXXX 6895 |
| HETATM | 6896 | O | HOH | S | 1050 | −30.520 | 63.362 | 24.121 | 1.00 | 0.00 XXXX 6896 |
| HETATM | 6897 | O | HOH | S | 1051 | −3.837 | 28.586 | 42.983 | 1.00 | 0.00 XXXX 6897 |
| HETATM | 6898 | O | HOH | S | 1052 | −20.810 | 63.133 | 36.562 | 1.00 | 0.00 XXXX 6898 |
| HETATM | 6899 | O | HOH | S | 1053 | 23.608 | 57.083 | 43.544 | 1.00 | 0.00 XXXX 6899 |
| HETATM | 6900 | O | HOH | S | 1054 | 18.649 | 63.905 | 70.596 | 1.00 | 0.00 XXXX 6900 |
| HETATM | 6901 | O | HOH | S | 1055 | 23.543 | 59.967 | 39.164 | 1.00 | 0.00 XXXX 6901 |
| HETATM | 6902 | O | HOH | S | 1056 | 23.806 | 68.226 | 70.171 | 1.00 | 0.00 XXXX 6902 |
| HETATM | 6903 | O | HOH | S | 1057 | −33.439 | 25.330 | 44.410 | 1.00 | 0.00 XXXX 6903 |
| HETATM | 6904 | O | HOH | S | 1058 | 31.907 | 53.824 | 67.417 | 1.00 | 0.00 XXXX 6904 |
| HETATM | 6905 | O | HOH | S | 1059 | −14.310 | 43.817 | 59.455 | 1.00 | 0.00 XXXX 6905 |
| HETATM | 6906 | O | HOH | S | 1060 | 4.421 | 66.579 | 29.538 | 1.00 | 0.00 XXXX 6906 |
| HETATM | 6907 | O | HOH | S | 11061 | 8.180 | 37.916 | 28.975 | 1.00 | 0.00 XXXX 6907 |
| HETATM | 6908 | O | HOH | S | 1062 | −26.740 | 60.599 | 33.581 | 1.00 | 0.00 XXXX 6908 |
| HETATM | 6909 | O | HOH | S | 1063 | 6.876 | 26.895 | 58.844 | 1.00 | 0.00 XXXX 6909 |

Example 10

Materials and Methods

Bioinformatic searches. Annotated genomic and plasmid sequences of 5062 prokaryotes were obtained from the National Center of Biotechnology Information (ftp://ftp.ncbi.nih.gov/genomes/Bacteria/all.gbk.tar.gz;), together with annotations recording prokaryotic lifestyles ( . . . /ProkaryotesOrganismInfo.txt). The Protein Databank (PDB) was obtained from www.rcsb.org. The obtained genomic and structural data files were organized into pre-processed two databases (PG, prokaryotic genomes; PDB). The 'ProteinHunter' program provides an interface and methods for organizing, querying, and analyzing these databases. ProteinHunter comprises a graphical user interface, set of computer scripts, and a parallel computing environment. Together these set up the calculations, manage the flow of information and execution in each of the calculation phases, control other programs that carry out specific calculations such as BLAST (Altschul et al., 1990, *J Mol Biol*, 215, 403-10) and ClustalW (Chenna et al., 2003, *Nucleic Acids Res*, 31, 3497-500), and visualize the results. Genomic contextual analysis was carried using the 'OntologyMgr' and 'LinkageViewer' programs. The former creates a database that integrates multiple homology searches produced by ProteinHunter using different seed sequences, and the latter examines neighborhood relationships between members of two or more homolog sets.

OntologyMgr loads in the lists of homolog sequences identified in ProteinHunter searches, recording their identifier (<Genome accession>|<Protein ID>), and location in the host genome sequence (stored as the start and stop coordinates DNA coordinates within the full genomic sequence of the open reading frame, and the strand on which the open reading frame is located: 'forward' or 'reverse'), and stores them in easily retrievable format. LinkageViewer reads in this information and assembles lists of open reading frames that are located in the same operon within a genome. For instance, let the ProteinHunter has identified three independent homolog sets, each seeded with a periplasmic binding protein, an ABC transporter ATPase, and an ABC transporter permease sequence, respectively. LinkageViewer then produces lists of operons that contain the binding protein, the ATPase and the permease. To generate such predicted operons, LinkageViewer first assembles lists of all three components within a given genome (i.e. sub-lists of all components that share the same genome accession code). Next it identifies combinations members drawn from each list, which are located within the same operon. Operons are defined as follows: all members are located on the same strand (forward or reversed); members are connected within a string of open reading frames whose successive stop-start codons are no more than a maximum distance apart (intercistronic distance limit; set to 100 bases in the calculations reported here). There may be other genes in such predicted operons; the three requested components need not be immediate neighbors; nor is their order within an operon specified. Both programs are implemented as Python scripts.

To construct homolog sequence sets, single sequence seeds were extracted from either preprocessed PDB or PG databases. Homolog sets were then identified in the PDB or PG by using a seed sequence for a uni-directional BLAST search. A pairwise BLAST alignment was scored in ProteinHunter as a homolog hit if it exceeded a minimum fraction of identical residues and if the alignment covered at least 70% of the probe and target sequences.

To infer function using genomic context analysis, homolog sets were loaded into the OntologyMgr database, which was then queried by LinkageViewer. The latter assembles lists of possible operons in a genome by identifying polycistron strings of open reading frames (ORFs) that are located on the same strand (i.e. point in the same direction) and are separated by no more than a maximum intergenic distance (typically 100 bases). Homolog sets are then combined to identify members drawn from each sets, that are co-localized in the same polycistron. A member of the paAmiC homolog set was inferred to be a urea-binding protein if it is located in the same polycistron as a urease homolog or a combination of ABC transporter components, as described in the main text.

Figure 3:
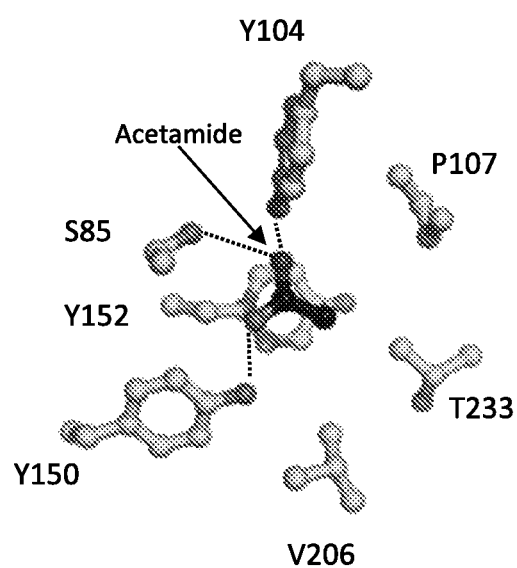
FIG. 3 is an illustration showing that residues that contact acetamide comprise the primary complementary surface in paAmiC [Protein Data Bank (PDB) accession code: 1pea]. T106 has been omitted for clarity; it forms van der Waals contacts with the acetamide plane facing the viewer.

Function also can be inferred using the sequence of primary complementary surface (PCS) residues. A 7-residue, non-contiguous sequence comprising the PCS between the protein and the bound acetamide in the 1pea structure (FIG. 3 and Table 1) was identified using ProteinHunter. PCS residues were selected as members of the PCS if the calculated distance between any of their atoms and any acetamide atom was less than 5 Å, and the distances between their backbone $C_\alpha$ and any atom in acetamide was greater than that of their $C_\beta$ atom and any atom in acetamide. Secondary shell residues that do not form hydrogen bonds or van der Waals contacts were removed by inspection from the resulting set. To determine the PCS sequence of members in the paAmiC homolog set identified in ProteinHunter, their sequences were aligned using ClustalW (Chenna et al., 2003, Nucleic Acids Res, 31, 3497-500). This alignment identifies the positions of the PCS residues in each homolog, from which the corresponding PCS sequence in that homology is then read. By combining this structure-based sequence information with the functional assignment using genomic context described above, the likely identity of residues in the PCS of urea-binding proteins was deduced (Table 1).

The putative urea-binding PCS filter was used to identify the subset of UBPs in the paAmiC homolog set. For each homolog, the number of PCS mutations relative to the urea-binding PCS (Hamming distance, $H_{PCS}$) was counted. Homologs with $H_{PCS}=0$ were inferred to be urea-binding proteins. The PCS sequences were displayed sorted by their $H_{PCS}$ values, and within each $H_{PCS}$ value sorted by their fraction identical residues, indicating the replicon within which they reside (chromosome or plasmid), whether this replicon contains paralogs, and the temperature tolerance (hyperthermophile, thermophile, mesophile, psychrophile, unknown), their Gram stain classification (if known), and the percentage genomic AT content. Duplicate hits were removed automatically from this list if the organism name (genus and species), fractional identity and paralogs were the same. From this list representative, unique UBP homologs with $H_{PCS}=0$ were chosen by inspection. In a subsequent phase of the analysis, the three-dimensional structure of csUBP7 was used to construct a known urea-binding PCS filter, and a new UBP homolog subset calculated (Table 1).

Gene synthesis and mutagenesis. The amino acid sequences for the predicted UBP homologs identified in the bioinformatic search (see above) were extracted from the PG database. The putative leader peptide that mediates anchoring of the periplasmic-binding protein on the outside of the membrane (Gram positive bacteria) or directs secretion into the periplasm (Gram negative bacteria) was deleted by examining the multiple sequence alignment and removing the sequences N-terminal to the start of the mature UBP amino acid sequence. The likely start of mature protein sequences was well-defined in this alignment, but a number of different start points were explored in design of the protein expression constructs (FIG. 6). Endogenous cysteines were changed to alanine. A hexahistidine tag was placed behind a GGS linker at the C-terminus of the mature protein to enable metal-mediated affinity purification (Hengen, 1995, Adv Healthc Mater, 2, 43-56). For three variants, the hyperacidic region used in the FATT tag (Sangawa et al., 2013, Protein Sci, 22, 840-50) followed by a rhinovirus C3 protease cleavage site (Cordingley et al. 1990 J. Biol. Chem., 265, 9062-9065) was fused to their amino termini. The final amino acid sequences were back-translated into a DNA sequence encoding the open reading frame (ORF), which was placed in a construct behind an efficient Shine-Dalgarno ribosome-binding site, and flanked by a T7 promoter and terminator at the 5' and 3' ends respectively, using the GeneFab program (Cox et al., 2007, Protein Sci, 16, 379-90). The resulting ORF sequences were optimized in context by OrfOpt program designed to predict highly expressed mRNA sequences in E. coli (see below). The resulting DNA sequences were synthesized by oligonucleotide assembly and cloned into pUC57 by GeneWiz, Inc. (South Plainfield, New Jersey).

Subsequent single and multiple point mutations were designed by preparing mutant sequences of the synthetic ORF sequences using the GfMutagenesis program that introduces point mutations into an ORF using the most prevalent codon in *E. coli* for an amino acid. Constructs for site-specific double labeling were designed by inserting the βZif domain sequence (Smith et al., 2005, *Protein Sci*, 14, 64-73) before the hexa-histidine C-terminal purification tag. All variants also were constructed by total gene synthesis.

Synthetic gene optimization. The OrfOpt program (U.S. Patent Publication No. 2011/0171737, incorporated by reference) uses stochastic optimization algorithms that alter choose different codons within an ORF without altering the amino acid sequence to optimize a target function designed to identify mRNA sequences that express proteins at high levels in *E. coli*. The OrfOpt simultaneously imposes AU-rich nucleotide composition at the 5' and 3' ends of the ORF, low RNA secondary structure content and favorable codon usage (Allert et al., 2010, *J Mol Biol*, 402, 905-18).

Protein expression, purification, and fluorescent conjugate preparation. Plasmids carrying the expression constructs (see above) were transformed into KRX competent cells (Promega), and grown overnight at 37° C. on LB agar plates (100 mg/mL ampicillin). A single colony was picked and grown overnight at 37° C. in Terrific Broth (TB; Research Products International). The overnight cultures were diluted 1:20 in 500 mL TB (100 mg/mL ampicillin), grown to an optical density of $A_{600}$=0.5 at 37° C. in vigorously aerated shaker flasks, induced by the addition of 2.5 mL rhamnose (20% w/v), and grown for a further 3-4 hrs. The cells were harvested by centrifugation (5,000 rpm, 10 min). After decanting the supernatant, the cell pellets were stored −80° C. The cell pellets were thawed, resuspended in 8 mL binding buffer (10 mM imidazole, 20 mM MOPS, 500 mM NaCl, pH 7.8). Following resuspension, 3 mL of BugBuster HT (EMD Millipore) was added. After incubation (20 mins, 25° C.), the cells were lysed on ice by sonication (2 minutes of one-second on/off pulses, 20-30% power). A clarified lysate was prepared by centrifugation (15,000 rpm, 20 min, 4° C.) from which recombinant protein was purified by batch immobilized metal affinity chromatography (IMAC). Resuspended IMAC agarose beads (5 mL; Sigma-Aldrich, P6611) were added to the lysate. After incubation at 4° C. in a Mini LabRoller (Labnet International) for 1 hr, the beads were washed at least five times with binding buffer. The immobilized protein beads were resuspended in labeling buffer (20 mM MOPS, 100 mM NaCl, pH 6.9) and labeled overnight (4° C., rotating end-over-end) with a thiol-reactive fluorophore (5-fold stoichiometric excess over protein). Following two rinses with labeling buffer to remove unincorporated label, the proteins were eluted from the beads. For double labeling of βZif fusions, a second thiol-reactive label was added following reduction of the disulfide with 5 mM TCEP. To elute labeled protein from the IMAC beads, 6 mL of elution buffer (400 mM imidazole, 500 mM NaCl, 20 mM MOPS, pH 7.8) was added, incubated for 30 min (4° C., rotating end-over-end), and the beads removed by centrifugation. Following dialysis of the eluate against three changes of assay buffer (20 mM MOPS, 20 mM KCl, pH 7.4), using 10 kDa semi-perimeable membrane (Snakeskin tubing, Thermo Scientific), the fluorescent conjugates were concentrated in a 10 kDa cutoff spin concentrator (Vivaspin, GE Healthcare). Protein purity was assessed by SDS/PAGE. Protein concentrations were determined by (Nanodrop1000) at 280 nm (using extinction coefficients calculated from their sequence (Gill and von Hippel, 1989, *Anal Biochem*, 182, 319-26; Artimo et al., 2012, *Nucleic Acids Res*, 40, W597-603), or at the fluorophore absorbance peak (Acrylodan, 391 nm and Badan, 387 nm).

Determination of temperature- and ligand-dependent fluorescence landscapes. 12-, 24-, or 48-point logarithmic titration series were prepared on a Tecan Freedom liquid-handling robot, using an in-house program, 'TitrationPlate', that compiles an abstract description of a multi-component titration series into machine instructions for operating the robot. Urea concentrations were varied from 0-4.8 M in 20 mM KCl, 20 mM MOPS (pH 7.4). Temperature-dependent fluorescence emission intensities of 20 μL aliquots, each containing 10 μM protein, were measured in 384-well microtiter plates in a LightCycler 480 II (Roche) using excitation and emission wavelengths available for this instrument that most closely matched the optical characteristics of the fluorescent conjugate. Temperatures were advanced in 1K steps. At each temperature, data was collected at 1-second intervals for 60 seconds at which point the signal had relaxed to a steady value associated with the new temperature. Under these experimental photobleaching was not observed. The in-house program 'TitrationMeltPlate' was used to convert these observations into time-independent datasets that record fluorescence as a function of temperature for each well and associate wells with their concentration of titrant and additive. Management tools were developed to maintain a database of titrations and their analyses.

Determination of emission intensity spectra. Ligand- and wavelength-dependent emission intensities were recorded on a Nanodrop3300 (Thermo Scientific) at room temperature. Using the LED closest to the optimal excitation wavelength of the fluorophore (UV, 365 nm; blue, 470 nm; 'white', 460-550 nm).

Ratiometric analysis of urea binding. Isothermal urea titrations were extracted from the fluorescent landscape or emission spectra datasets obtained as described above. Monochromatic emission intensities $I_\lambda$ (these intensities correspond to a bandpass intensity, recorded either with a physical filter in the case of the Roche LightCycler, or by integrating in the interval λ−δ, λ+δ in the case of an emission spectrum), were fit to $$I_\lambda = {}^{apo}\beta_\lambda(1-\bar{y}_{true}) + {}^{sat}\beta_\lambda \bar{y}_{true} \qquad 1$$

where ${}^{apo}\beta_\lambda$ and ${}^{sat}\beta_\lambda$ are the fluorescence baselines associated with the ligand-free and ligand-bound states of the protein, respectively, and $\bar{y}_{true}$ the fractional saturation of the protein (Layton and Hellinga, 2010, *Biochemistry*, 49, 10831-41). Baseline functions can be constant, linear, or a second-order polynomial. For the ligand- and temperature-dependent fluorescence landscapes, we use a constant value for ${}^{apo}\beta_x$, but ${}^{sat}\beta_x$ is described by a linear dependence on urea concentration, [L]:

$$^{sat}\beta_x = a_x + b_x[L] \qquad 2$$

For a single urea-binding site, the fractional saturation is given by $$\bar{y} = \frac{[L]}{[L] + K_d} \qquad 3$$

where [L] is the ligand (urea) concentration and $K_d$ the dissociation constant, ${}^{true}K_d$ for $\bar{y}_{true}$.

A ratiometric signal at a given point in a titration series, $R_{1,2}(t)$, is given by the ratio of intensities at two wavelengths, $^{obs}I(\lambda_1, t)$, $^{obs}I(\lambda_2, t)$ in the emission spectrum measured at that point:

$$R_{12}(t) = \frac{a_t{}^{obs}I(\lambda_1, t)}{a_t{}^{obs}I(\lambda_2, t)} \qquad 4$$

where $a_t$ is an attenuation factor that describes the effect of variations in sample size (i.e. the amount of observable fluorophore) in the $t^{th}$ sample on the wavelength-independent intensity of the entire emission spectrum. This signal removes wavelength-independent emission intensity attenuation effects due to variations in conjugate concentration, photobleaching, fluctuations in excitation source intensities, and detection efficiency (Demchenko, 2010, *J Fluoresc*, 20, 1099-128; Demchenko, 2014, *Journal of Molecular Structure*, 1077, 51-67). It is a key aspect for high-precision sensing using the reagentless fluorescently-responsive sensors described here. The ratiometric signal also can be fit to a binding isotherm:

$$R_{1,2} = {}^{apo}\beta_R(1-\bar{y}_R) + {}^{sat}\beta_R \bar{y}_R \qquad 5$$

where $^{apo}\beta_R$ and $^{sat}\beta_R$ are the baselines, and $\hat{y}_R$ the apparent fractional saturation of the protein (with $^{app}K_d$). In general, $^{true}K_d \neq {}^{app}K_d$; if both baselines are constant, a simple relationship can be derived relating $^{app}K_d$ to $^{true}K_d$ (Grimley et al., 2013, *J Neurosci*, 33, 16297-309):

$$^{app}K_d = {}^{true}K_d \frac{^{apo}I_{\lambda 2}}{^{sat}I_{\lambda 2}} \qquad 6$$

where $^{app}I_{\lambda 2}$ and $^{sat}I_{\lambda 2}$ are the emission intensities of the monochromatic signal at wavelength $\lambda_2$ of the ligand-free and ligand-bound protein, respectively.

Following a fit of the titration series using equations 4 and 5, $a_t$ values can be recovered by taking the average comparison of the observed and calculated intensities at the two wavelengths:

$$a_t = \frac{1}{2}\left(\frac{^{calc}I(\lambda_1, t)}{^{obs}I(\lambda_1, t)} + \frac{^{calc}I(\lambda_2, t)}{^{obs}I(\lambda_2, t)}\right) \qquad 7$$

The $a_t$ value can then be applied to all wavelengths to obtain an emission spectrum or integrated intensity of the $t^{th}$ titration point corrected for variations in sample size:

$$^{corr}I(\lambda) = a_t {}^{obs}I(\lambda) \qquad 8$$

where $^{corr}I(\lambda)$ and $^{obs}I(\lambda)$ are the wavelength-dependent intensities of the corrected and observed emission spectra, respectively.

The fractional error in the chemometric concentration measurement, depends on the first derivative of the binding isotherm as follows (Marvin et al., 1997, *Proc Natl Acad Sci U S A*, 94, 4366-71):

$$\frac{\partial S}{S} = \frac{\varepsilon_{1,2}}{S} \times \left(\frac{dR_{1,2}}{dS}\right)^{-1} \qquad 9$$

where $R_{1,2}$ is the ratiometric signal (equation 5), $\varepsilon_{1,2}$ its experimental error, and $\delta S$ is the resulting chemometric error in the concentration. We can then define a relative precision function $$P(S) = \frac{S}{\delta S} \times \frac{1}{P_{max}} \qquad 10$$

where $P(S)$ is the relative precision at concentration $S$, which reaches a maximum value (i.e. lowest error), $P_{max}$, at the $K_d$.

For a given isothermal titration, values for $^{app}K_d$ and $^{true}K_d$ were obtained using a non-linear fitting algorithm in which these two parameters were simultaneously fit to the three experimental binding isotherms using equations 1 and 5, with the two monochromatic isotherms sharing the same $^{true}K_d$ value. Three separate pairs of $^{app}\beta$ and $^{sat}\beta$ were fit in this procedure, corresponding to the two monochromatic and the ratiometric signals, respectively. Two distinct ratiometric response models can be used: coupled (both wavelengths respond to ligand); uncoupled (the second wavelength is non-responsive; i.e. remains constant). Optionally, an attenuation vector, $a(t)$ containing $a_t$ values for each titration point (equation 7), can be refined by iterative fit cycles in which the $a(t)$ vector of a previous cycle is used to adjust the integrated intensities of the next cycle. Programs 'Nanodrop3300' and 'TitrationMeltAnalysis' were developed to analyze wavelength- or temperature-dependent ligand-binding datasets respectively.

Analysis of urea-binding properties using thermal melts. The thermal stability of purified UBP candidate proteins was determined by measuring the temperature-dependence of the fluorescence signal of an extrinsically added dye, SYPRO, using a Roche LightCycler (Layton and Hellinga, 2010, *Biochemistry*, 49, 10831-41). The total fluorescence intensity, $S$, is given by $$S = \beta_F f_F + \beta_U f_U \qquad 11$$

where $f_F$ and $f_U$ are the fractions of protein in the folded and unfolded states, respectively, and $\beta_F$ and $\beta_U$ the fluorescence baselines of these two states. To get the fractions of the two states, we have $$f_N = \frac{1}{1 + K_U(T)} \text{ and } f_U = 1 - f_N \qquad 12$$

where $K_U(T)$ is the temperature-dependent unfolding equilibrium constant, which by the van't Hoff approximation is given by $$K_U = e^{-\Delta H_U\left(\frac{1}{T} - \frac{1}{T_m}\right)/R} \qquad 13$$

where $T$ is the temperature, $T_m$, the unfolding reaction transition mid-point temperature, and $\Delta H_U$ the enthalpy of unfolding.

To obtain the temperature dependence of the binding reaction, the $K_d$ values of all the individually determined isotherms were fit the Gibbs-Hemholtz equation (Layton and Hellinga, 2010, *Biochemistry*, 49, 10831-41):

$$\Delta G_b^\bullet(T) = \Delta^{ref}H_b^\bullet + \Delta C_{p,b}(T - T_{ref}) - T\left(\Delta^{ref}S_b^\bullet + \Delta C_{p,b} \ln\frac{T}{T_{ref}}\right) \qquad 14$$

where $\Delta G_b^{\circ}(T)$ is the standard free energy of binding at 1 M ligand at temperature T, $$\Delta G_b^{\bullet}(T) = -RT \ln\left(1 + \frac{1}{K_d(T)}\right) \qquad 15$$

$\Delta^{ref}H_b^{\bullet}$ and $\Delta^{ref}S_b^{\bullet}$ the molar enthalpy and entropy of binding, respectively, at the reference temperature, $T_{ref}$, and $\Delta C_{p,b}$ the heat capacity of the binding reaction. This data analysis was carried out using 'TitrationMeltAnalysis'.

Structure determination by X-ray crystallography. Sparse-matrix crystallization screens of purified csUBP7 in the presence of 5 mM urea were carried out at 17° C. out using the sitting-drop vapor diffusion method. Clusters of thin plates were found in 0.2 M ammonium sulfate, 0.1 M sodium acetate (pH 4.6), 25% polyethylene glycol 4,000. Individual crystals were obtained from the clusters by dissection and flash frozen in liquid nitrogen following stepwise transfer into a cryoprotectant solution containing 30% additional ethylene glycol. Diffraction data was collected on the ALS synchrotron, using the SIBYLS beamline 12.3.1. The crystals diffracted to 1.8 Å resolution. A total of 700 frames were collected with a 0.4° oscillation angle and processed using the XDS program (Kabsch, 2010, *Acta Cryst.*, D66, 125-132). Initial phases were calculated by molecular replacement using the paAmiC poly-alanine structure (Pearl, 1994, *EMBO J.*, 13, 5810-5817; O'Hara, 1999, *EMBO J.*, 18, 5175-5186) as the search model. The data analysis using phenix.triage indicated the presence of translational pseudo-symmetry. Accordingly, the molecular replacement solution was calculated using PHASER (MC-Coy, 2007, *J. Appl. Cryst.*, D66, 125-312) with the translation NCS option enabled. The csUBP7 crystal belongs to the $P2_12_12_1$ space group and contains two molecules in the asymmetric unit with solvent and Matthews coefficient of 0.50 and 2.46 $A^3$/Da, respectively. Initial model building and density modification was carried out using the PHENIX. AutoBuild program (Adams, 2010, *Acta Crystallogr D Biol Crystallogr*, 66, 213-331). Multiple cycles of iterative model building by visual inspection of the electron density maps and refinement calculations (positional, individual B-factor, torsion-angle NCS, stereochemistry weight optimization) were carried out using COOT (Emsley, 2004, *Acta Crystallogr D Biol Crystallogr*, 60, 2126-2132) and PHENIX (Adams, 2010, *Acta Crystallogr D Biol Crystallogr*, 66, 213-331). The electron density for urea was clearly visible in the ligand-binding site in a $F_oF_e$ electron density map contoured at 3σ. Solvent was added automatically using phenix.refine and adjusted by manual inspection. The final model R-factor and R-free values of 18.67% and 25.58%, respectively. Crystallographic data collection and refinement statistics are show in Table 5.

Mechanisms for Ligand Sensing using Non-Geometric Modulation of ngmFRET.

The subject matter disclosed herein is not limited to or bound by any particular scientific theory. However, discussions regarding ngmFRET are provided to facilitate the understanding of possible mechanisms involved with ngmFRET signaling in various embodiments described herein. Equations for calculating various values mentioned herein are also provided.

The total signal, S, of a fluorescent sensor (either single-wavelength emission intensities, $I_\lambda$, or ratios of intensities at two wavelengths, $R_{12}$) is the sum of the fluorescence due to the ligand-free (apo) and ligand-bound states:

$$S = \alpha(1-\bar{y}) + \beta\bar{y} \qquad 16$$

where α and β are the fluorescent baselines in the ligand-free and -bound states, respectively, and $\bar{y}$ is the fractional occupancy of the binding sites (equation 3).

Fluorescence quantum yields are the fractions of photons emitted by the excited state relative to the total absorbed, and correspond to the ratio of the radiative decay rate relative to the sum of the rates of all possible decay pathways (FIG. 16). For a single fluorophore:

$$Q = \frac{k_r}{k_r + k_{nr}} \qquad 17$$

where $k_r$ and $k_{nr}$ are the radiative and non-radiative decay rates of the excited state, respectively. If we define q as the ratio between the radiative and non-radiative decay rates, $$q = \frac{k_{nr}}{k_r} \qquad 18$$

then the quantum yield can be written as $$Q = \frac{1}{q+1} \qquad 19$$

Chemical sensors exploit the ligand-mediated shift of a fluorescent system between the ligand-free and ligand-bound states which each exhibit distinct quantum yields:

$$Q_{obs} = Q_{apo}(1-\bar{y}) + Q_{sat}\bar{y} \qquad 20$$

where $Q_{obs}$, $Q_{apo}$ and $Q_{sat}$ are the quantum yield of the total system, the apo-protein, and the ligand-bound complex, respectively. In a system involving ngmFRET between a donor and acceptor fluorophore, the $Q_{apo}$ and $Q_{sat}$ quantum yields each are combinations of their respective donor and acceptor quantum yields:

$$Q_{apo} = {}^D Q_{apo} + {}^A Q_{apo} \text{ and } Q_{sat} = {}^D Q_{sat} + {}^A Q_{sat} \qquad 21$$

where the superscripts D and A indicate donor and acceptor fluorophores respectively. To understand ngmFRET-based sensors, we therefore need to examine the factors that affect each of these four quantum yields.

The rate of energy transfer, $k_t$, along a non-radiative pathway between donors and acceptors is a fraction of the donor radiative emission pathway rate (by itself and regardless of the presence of any other fluorophore/parter), $^D k_r$ (the emission rate in the absence of an acceptor) multiplied by the energy transfer coupling factor, φ:

$$k_t = \varphi Q_D {}^D k_r \qquad 22$$

where $Q_D$ is the donor quantum yield in the absence of an acceptor. According to the Förster model of weakly coupled oscillators (Lakowicz, 2006, Principles of fluorescence spectroscopy. Springer, New York; Valeur, 2012, Molecular Fluorescence. Principles and Applications. Weinheim: Wiley), the energy transfer coupling factor is dependent on the spectral overlap, J, of the donor emission, $^D\lambda_{em}$, and acceptor excitation spectrum, $^A\lambda_{ex}$, and the variation of the geometry, G, between the donor and acceptor excited state transition dipoles with distance, r, and orientation factor, κ:

$$\varphi = G(r, \kappa) J(^D\lambda_{em}, {}^A\lambda_{ex}) \frac{9000 \ln 10}{128\pi^5 N_A n^4} \quad 23$$

where $$G(r, \kappa) = \frac{\kappa^2}{r^6} \quad 24$$

and $$J(^D\lambda_{em}, {}^A\lambda_{ex}) = \int F(^D\lambda_{em}) \varepsilon(^A\lambda_{ex}) \lambda^4 d\lambda \quad 25$$

with n the refractive index of medium, $N_A$ Avogrado's number, $F(^D\lambda_{em})$ the normalized donor emission spectrum, and $\varepsilon(^A\lambda_{ex})$ the absorption coefficient of the acceptor excitation spectrum [this analysis is a re-arrangement of the traditional presentation of the equations describing tgmFRET, separating the different contributions (geometry, spectral overlap, quenching)].

At steady state, the concentration of the donor excited state, [D*], is given by the following rate balance equation (see FIG. 16A) and applying equations 5 and 8:

$$N_0 \alpha k_{ex} - [D^*](^Dk_{nr} + {}^Dk_r + k_t) = N_0 \alpha k_{ex} - [D^*]^D k_{nr}\left(1 + d + \frac{\varphi}{1+d}\right) \quad 26$$

where $N_0$ is the population of ground state fluorophores, $k_{ex}$ the rate of excitation photon absorption, α the effective illumination, and d the ratio between the radiative and non-radiative decay rates (analogous to equation 4). Hence $$[D^*] = \frac{N_0 \alpha k_{ex}}{^Dk_{nr}\left(1 + d + \frac{\varphi}{1+d}\right)} \quad 27$$

The intensity of the emitted donor light, $I_D$, is $$I_D = [D^*]^D k_r = \frac{N_0 \alpha k_{ex}}{\left(1 + d + \frac{\varphi}{1+d}\right)} \quad 28$$

The donor quantum yield, $Q_D$, is this emission intensity relative to the intensity of the excitation, $k_{ex} \alpha N_0$ $$Q_D = \frac{1}{\left(1 + d + \frac{\varphi}{1+d}\right)} \quad 29$$

The rate balance equation for the acceptor excited state concentration, [A*], is given by $$[D^*]k_t - [A^*](^A k_r + {}^A k_{nr}) \quad 30$$

Consequently, by applying equations 5, 8 and 13, the acceptor quantum yield, $Q_A$, is $$Q_A = \frac{\varphi}{(1+a)(1+d)\left(1 + d + \frac{\varphi}{1+d}\right)} \quad 31$$

where a is the ratio of the radiative and non-radiative pathways in the acceptor. The ratio of the acceptor and donor quantum yields therefore is $$\frac{Q_A}{Q_B} = \frac{\varphi}{(1+d)(1+a)} \quad 32$$

Figure 16A:
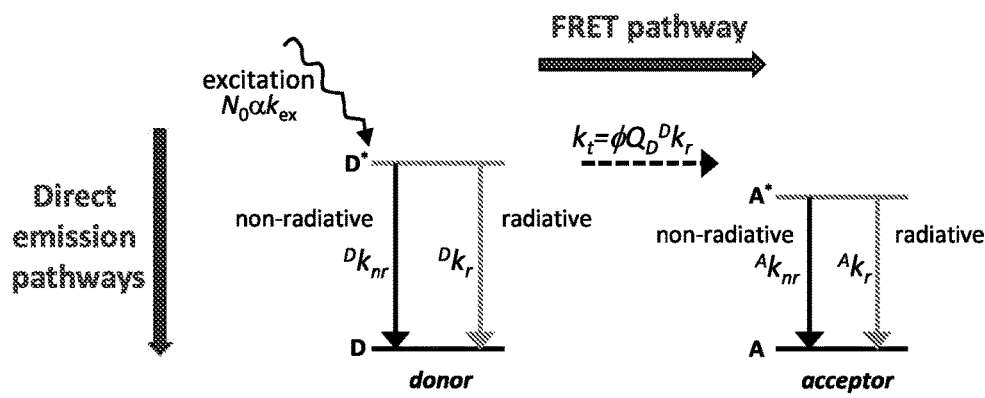
FIGS. 16A-D are diagrams showing three dominant factors that affect ngmFRET between donor and acceptors in which one partner responds to ligand binding.
Figure 16B:
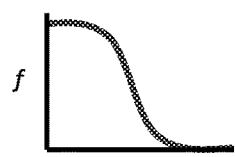
Figure 16C:
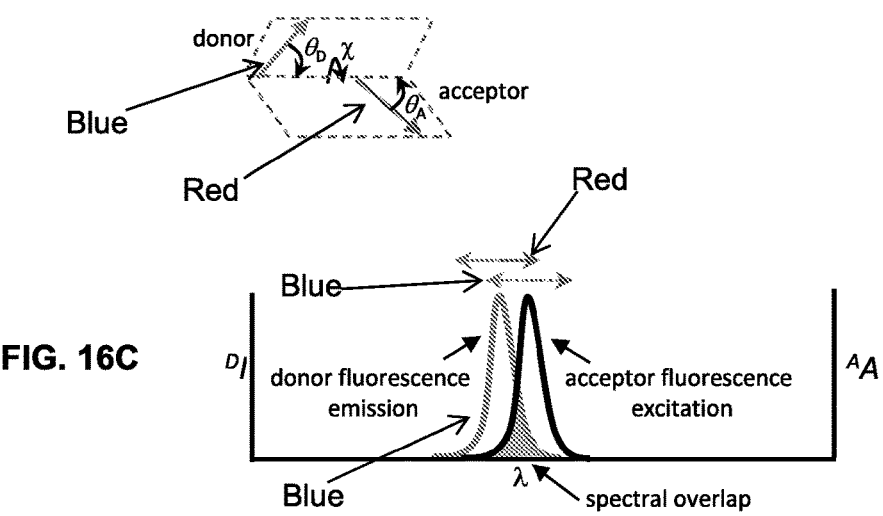
Figure 16D:
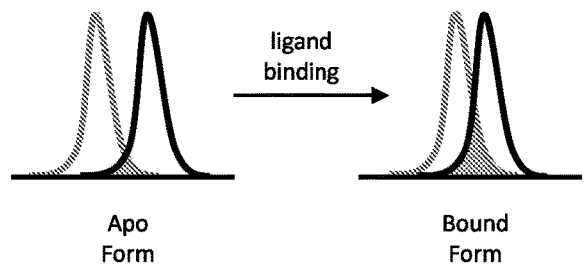

In ngmFRET-based systems, chemical sensing therefore arises from ligand-mediated changes in the rates of the emissive pathway of the donor or acceptor fluorophore and the ngmFRET between them (FIG. 16A). These are affected by the ligand-mediated modulation of the directly responsive partner (DRP) by altering the ratio of radiative and non-radiative decay rates (this "quenching" effect alters the d or a parameters if the DRP functions as donor or acceptor, respectively, equations 29 and 31), and the energy transfer coupling factor, φ, that modulates its resonance with the indirectly responsive partner. A change in any of these three parameters alters the ratio of the donor and acceptor quantum yields (equation 32), thereby enabling ratiometry.

Ligand-mediated donor DRP quenching affects the quantum yields of both the donor, $Q_D$, and acceptor, $Q_A$, quantum yields (equations 29, 31). Quenching of an acceptor DRP alters only $Q_A$ (equation 31).

Changes in φ affect quantum yields of both fluorophores, regardless whether the DRP functions as the donor or acceptor (equations 23-25, 29, 31). For systems in which there is no ligand-mediated change in the (average) distance between the two fluorophores, φ changes only if the DRP switches between two different excited state populations ("dipole switching") in response to ligand binding and if the two excited states differ in their spectral properties (emission for donor DRPs; absorption for acceptor DRPs). Excited state dipoles usually also differ in their dipole orientations, so it is likely that changes in spectral overlap involve (re-)orientation effects. They are also likely to differ in the relative rates of their radiative and non-radiative decay rates. Dipole switching therefore is likely to involve a combination of changes in ngmFRET and quenching effects.

There are eight possible combinations of ligand-mediated changes in quenching and ngmFRET parameters, which have different outcomes on the two emission intensities and their ratio, depending on whether the DRP is the donor or acceptor. The qualitative behavior of the resulting sixteen possibilities in ngmFRET systems are shown in Table 12. Twelve of these have a predictable outcome on the direction of change in the ratio of the two emission intensities. The effect on the direction of change for both donor and acceptor emission intensities can be predicted for seven models. For the other models, the direction of change of one or both peaks depends on the size of the change in the underlying parameters. Purely geometric effects (changes in inter-dipole distance or orientation) always result in anti-correlated changes in emission intensity changes (i.e. one increases and the other decreases, or vice versa). Correlated (i.e both intensities increase or decrease) or uncorrelated (one changes, the other remains constant) intensity changes therefore are prima facie evidence for an ngmFRET effect.

Example 11

Urea Biosensors and Uses Thereof

Urea-binding proteins have been identified accurately using a bioinformatics search strategy that combines genetic linkage and protein structural information. The X-ray structure of a thermostable urea-binding protein from *Caldicellulosiruptor saccharolyticus* (csUBP7) has been determined to 1.8 Å resolution. csUBP7 has been successfully engineered into a ratiometric, reagentless fluorescent urea biosensor, capable of monitoring urea concentrations over four orders of magnitude, including the clinical reference range. This range can be extended to six orders of magnitude by judicious combinations of fluorophore conjugate and affinity tuning mutations. Ratiometric sensors were constructed using singly labeled conjugates that undergo ligand-mediated shifts in the shape and intensities of their emission spectra, and by incorporating monochromatically responding fluorophores into dually labeled systems that exploit non-geometrically modulated fluorescence energy transfer (ngmFRET). One of the ngmFRET systems exploits the response of Alexa532 which changes in intensity through an unexpected mechanism involving exchange between dark and fluorescent excited states.

The urea biosensors reported here have utility in point-of-care devices for clinical and on-site environmental chemistry. They may also be incorporated into continuous monitoring instrumentation for clinical as well as environmental, food and beverage production and storage, and/or industrial applications.

The urea sensors provided herein can be incorporated into point-of-care clinical devices to measure urea concentrations accurately, and rapidly at the patient bedside. In a non-limiting example of such a device, a small blood sample (<10 µL) may be obtained by means of a finger stick using, e.g., a lancet. This sample droplet is then placed on the aperture of a disposable cartridge containing desiccated, immobilized urea sensors inside a small measurement chamber. The sample enters the chamber by virtue of passive capillary action, wetting the sensors upon contact. As soon as the sensors have been wetted, they bind urea, and report on its concentration by virtue of the engineered fluorescent sensor mechanism. The cartridge is placed inside a small reader (handheld or on a desktop), and their fluorescence signal is measured by the (inexpensive) optoelectronic components of the reader. Excitation light is provided by a light-emitting diode (LED). In the case of Acrylodan or Badan, a commercially available 400 nm blue LED is used, and the emitted light is measured through two bandpass filters. Cartridges can contain multiple sensors, spanning the entire clinical range of possible urea concentrations. Each sensor is immobilized at a particular, known location inside the cartridge, providing "spatial addressability". The intensity at a particular wavelength is then recorded by imagining these sensors using an inexpensive camera, such as a Complementary metal-oxide semiconductor (CMOS) device commonly found in consumer electronics such as cell phones. Each pixel in the camera records the emitted light on a gray scale. Integration of that signal imaged through the two signals, is analyzed by an on-board computer to calculate the ratiometric signal for each immobilized sensor. Pre-recorded hyperbolic binding curves are then used to calculate the urea concentration in the sample. Recording through multiple sensors, tuned for accurate detection at different urea concentrations provides a high-accuracy reading. This process is completed in less than a minute.

Similar instrumentation can be used for any type of episodic measurements, for instance, using other bodily fluids, or samples obtained from animals, or non-biological samples such as foods and beverages.

The FRS urea sensors also can be used to monitor urea levels continuously. For instance, sensors can be immobilized at the tip of a thin optical fiber to construct a urea-responsive optode. Such an optode can be introduced into the body subcutaneously, using a small needle. Excitation and emission light are passed to and from the immobilized sensor, respectively. The sensor is in continuous contact with the sample. Fluctuations in the urea sample alter the dynamic equilibrium between the open and closed states of the urea-binding protein, which is transduced into fluctuations of the fluorescent emission signal, by virtue of the sensing mechanism of the conjugated fluorophore. The emitted light intensities are read through filters by a reader connected to the optode. This reader continuously displays the change in signal, and the corresponding calculated urea concentrations. Continuous urea monitoring accomplished using a device containing the immobilized urea biosensor(s), e.g., a fiber optic biosensor, introduced into the subject intradermally or subcutaneously (Judge et al., 2011, Diabetes Technology & Therapeutics 13 (3):309-317; Weidemaier et al., 2011, Biosensors and Bioelectronics 26:4117-4123; hereby incorporated by reference).

As was discussed above, the features that distinguish the described constructs, devices, and methods from earlier urea assay systems include:

Self-calibration
Rapid response time
Simple sample-handling fluidic circuitry
No additional components/substrates ("reagentless")
No incubation time to develop signal. Reading is near-instantaneous and continuous
Stability (simplifies manufacturing, distribution, storage)
Small sample volume (<10 µL).
Capable of precise measurements over extended urea concentration range (from the hypouremia (e.g., a concentration of less than about 2 mM in the blood) to the hyperuremia range (e.g., a concentration of more than about 7 mM in the blood).
Multiple sensors also provides redundancy, lowering error
Large scope of uses: episodic, continuous, ex vivo, in vivo, optodes, implants.

Other Embodiments

While the invention has been described in conjunction with the detailed description thereof, the foregoing description is intended to illustrate and not limit the scope of the invention, which is defined by the scope of the appended claims. Other aspects, advantages, and modifications are within the scope of the following claims.

The patent and scientific literature referred to herein establishes the knowledge that is available to those with skill in the art. All United States patents and published or unpublished United States patent applications cited herein are incorporated by reference. All published foreign patents and patent applications cited herein are hereby incorporated by reference. Genbank and NCBI submissions indicated by accession number cited herein are hereby incorporated by reference. All other published references, documents, manuscripts and scientific literature cited herein are hereby incorporated by reference.

While this invention has been particularly shown and described with references to preferred embodiments thereof, it will be understood by those skilled in the art that various changes in form and details may be made therein without departing from the scope of the invention encompassed by the appended claims.

SEQUENCE LISTING (247 sequences)

SEQ ID NO: 1 - protein, 427 aa, Marinomonas posidonica
MKIKTLASAIALSGATLIAFPSLAADTIKVGVLHSLSGTMAISETTLKDTVLMMVEEQNKKGGLLGKKLEAVVVDPASNWPLFAEKARELLTEDQVDVIFGCWTSVSRKSVLPVIEELNGLMFYPVQYEGEESSYNVFYTGAAPNQQAIPAVNYLKDELGVERWVLAGTDYVYPRTTNKILEAYLKDMGVAEDDIMINYTPFGHSDWQSIVSDIKKFGSAGKKTAVVSTINGDANVPFYKELGNQGISSEDIPVVAFSVGEEELSGLDTAPLVGHLAAWNYFQSVETDENEEFITKWQAYTKNPERVTNDPMEATFIGFNMWANAVTEAGTTDVDAVEKAMIGQETPNLTGGIAVMNKNHHLSKPVLIGEIQDDGQFETVWETDGVVPGDAWSDFLPGSKDLVADWTDPLKCGNYNTETKMCSGQNY

SEQ ID NO: 2 - protein, 427 aa, Marinobacter hydrocarbonoclasticus
MKLGLSALALSVSLNSVAAEDPIKVGILHSLSGTMAISETALKDTMLMLIEKQNEAGGVLGRQLEPVVVDPASNWPLFAEKARELLEKEKVDVIFGNWTSVSRKSVLPVVEELNGLLFYPVQYEGEESSENVFYTGAAPNQQAIPAVDYLMNDLGVERWVLAGTDYVYPRTTNKILETYLKDKGVAAGDIMINYTPFGHSDWQTIVSDIKKFGSAGKKTAVVSTINGDANVPFYRELGNQGISATDIPVVAFSVGEQELSGIDTAPLVGHLAAWNYFMSVDNDANYDFIDAWVAYKGDDAAVTNDPMEAHYIGFNMYVEAVKKAGTTDVDEVKDAIIGVSVPNLTGGYATMMPNHHITKPVLIGEIQDNGQFSVVWETPSTVAGDAWSDFLPGSKDLISDWRAPLRCGNFNVVTGKCGGGSADVASN

SEQ ID NO: 3 - protein, 418 aa, Bacillus sp.
MKNKRVGIQAVFLLCLIMVLMAGCAAPKKVSEASGSAKKTVDIDTSGDSVKVGILHSLSGTMAISEVSVHDAELIAIQEINQKGGVLGKKLEPVVEDGASDWPTYAEKMRKLLQQDKVAAVFGGWTSASRKAMLPVVEQNNGLLFYPVQYEGMETSPNIFYTGATTNQQIVPAVDWLLKNKGKKFFLIGSDYVFPRTANKIIKAQVKAGGGEIAGEEYTPLGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSK

SEQ ID NO: 4 - protein, 420 aa, Desulfotomaculum nigrificans
MGRSFKRFFKPHILFSVMVLVTMLLLAGCGGSGSPKKEDTVSNQKAGEGETIKVGILHSLSGTMAISEVSVKDAELMAIEEINASGGLLGKKIEPVIEDGASDWPTFAEKAKKLLQQDKVAVIFGGWTSASRKAMLPVVEENNGLLFYPVQYEGLESSPNIFYTGAEPSQQIVPAVSWLLENRGKKFYLLGSDYVFPRTANKIIKAQLKAKGGEVVGEEYTPLGHTDYSTIINKIKAAKPEIIFNTLNGDSNVAFFKQLKDAGITSKDITVMSVSIAEEEIRGIGPQNIAGHLAVWNYFQTTDTPENKEFVKKFKTKYGQDRVTDDPIEAGYFGVYLWAEAVKKANSTDVGKVKEAIKTVEFQAPEGLVKINGENQHTWKTVRIGEVQPDGQFKELWNSGGPVKPDPYLKGYEWAKGLSN

SEQ ID NO: 5 - protein, 412 aa, Geobacillus thermoglucosidasius
MKLKWVALLLYAFVFVLSGCAASSAVDEVKEKPKETSASETGDTVKVGILHSLSGTMAISEVSLRDAELMAIEEINKSGGLLGKKIEPVIEDGASDWPTFAEKAKKLLQKDKVAAIFGGWTSASRKAMLPVVEQNNGLLWYPVQYEGMESSPNIFYTGATTNQQIVPAVSWLLENRGKRFFLLGSDYVFPRTANKIIKAQLKAEGGQLVGEEYTPLGHTDYSTIINKIKEVKPDVVFNTLNGDSNVAFFKQLKDAGITAKDVTVMSVSIAEEEIRGIGGDVLAGHLAVWNYFQSTDTPENKAFVEKYKKKYGKERVTDDPIEAAYFAVHLWAEAVKKAGSFDVDKVKKAADGIEYKAPGGTVKIDGETQHTWKIVRIGEIQANGQFKELWNSGKAVKPDPYLKSYPWAKNLN

SEQ ID NO: 6 - protein, 419 aa, Ruminiclostridium thermocellum
MIKKFCIFGKNTIKVLAIALSALLVFAGCSGKVEEPVDNKPGTDTSAEDTIKVGILHSLSGTMAISEVSLKDAELMAIEEINQAGGLLGKKIEPVIEDGASDWPTFAEKAKKLLQNDKVATVFGCWTSASRKAVLPVFEENNGLLWYPVQYEGMESSPNIFYTGAAPNQQIVPAVEWLLENKGKRFFLLGSDYVFPRTANKIIKAQLSAIGGELIAEEYTPLGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSD

SEQ ID NO: 7 - protein, 415 aa, Caldicellulosiruptor saccharolyticus
MRKSNKMLIKMLSLLLVIVMVVAVLYGCKKSSSSSESEKEKSEETIKVGILHSLSGTMSISEVSLKDAELMAIEEINNNGGVLGKKLEPIVEDGASDWPTFAEKAKKLLQKDKVAVIFGCWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQ

SEQ ID NO: 8 - protein, 404 aa, Thermocrinis albus
MKSGYANRRDFIKASAAVITLHTIAPALVWPSPKKIKVGVLHSLSGTMAISEVHVKNATLLAIEEINRKGGVLGYTIEPIIEDGASDPATFAQKAQKLILMDKVVTVFGGWTSASRKAMLPVFERYKNLLWYPVQFEGNECSPNIIYTGAQPNQQILPALEWALKQGYKKFFLVGSDYVFPRTANLILKKHIQKNGAIVSGEEYVPLGGTDFSAVVNKIINTKPDIVFNTINGDSNVAFFKQMAAAGVGPKVLPVISFSIAEQEAKAIGIPLLEGSYAAWNYFMSLNNKANLEFIKAYQGKYGKSSLITDPMAHGYMNVYLWKMAVEKAGTFDPMMVRKAATELPWVDSPFGKIKIAKNQSLYQTAYIGKLGSDGQFSIVWSSGKPIEPEPYDKLVFPGKKCVL

SEQ ID NO: 9 - protein, 418 aa, Geobacillus kaustophilus
MKPKFMRKLWLLLCISVFALGGCAASSAVDQAKNENKKDSSSASKEGDTVKVGILHSLSGTMAISEVSLRDAELMAIEEINASGGLLGKKIEPVVEDGASDWPTFAEKAKKLLQKDQVAAIFGGWTSASRKAMLPVVEQNNGLLWYPVQYEGMESSPNIFYTGATTNQQIVPAVSWLLKNRGKTFFLLGSDYVFPRTANKIIKAQLKAEGGQVVGEEYTPLGHTDYSTIISKIKQVKPAVVFNTLNGDSNVAFFKQLKDAGITPKDVTVMSVSIAEEEIRGIGPDVLAGHLAVWNYFQTTDTPENKAFVQKYKEKYGQDRVTDDPIEAAYTAVHLWAEAVKKAGSFDVDQVKKAAAGLEYKAPEGTVKIDGETQHLWKTVRIGEIQADGQFKELWNSGQPVKPDPYLKSYPWAKGLSE

SEQ ID NO: 10 - protein, 419 aa, Paenibacillus sp.
MKKQSVIVKGWASFVLCAILMSGCVTEKETAPTAGAGNGSPPVEAAGDSIKVGILHSLSGTMAISEVSVKDAEMLAIEEINAAGGVLGKQIEPVIEDGASDWPTFAEKAGKLLQQDKVAAVFGGWTSASRKAMLPVFEQNHGLLFYPVQYEGLESSPNIFYTGATTNQQIVPSVSWLLENRGKKMFLLGSDYVFPRTANKIIKAQLTAEGGELAGEEYTPLGHTDFSTIIAKIKEAKPDIVYNTLNGDSNVAFFKQLKDAGTTSKDMTTLSVSVAEEEIRGIGADILEGHLAAWNYYQSTDTPENKAFVDKYKAKYGADRVTADPIEAGYTAVYLWKAAVEKAGTTDVDKVKEAAKGIEFAAPEGKVTIDGDNQHIHKTVRIGEVQADGQFKELWNSGEPVKPDPYLKTYDWAKGLSGE

SEQ ID NO: 11 - protein, 437 aa, Roseobacter denitrificans
MAQRFELGRRKFLVYGSAALGTSLLIKGCAPATETGGGGQTPATGGDTIKVGILHSLSGTMAISEKSVVDATQLAIEQINQAGGVLGKQIQPILEDGASDWPTFAEKATKLIDQDKVVAVFGCWTSASRKAVLPVFESKNHMLWYPVQYEGQECSKNIFYTGAAPNQQIEPAVDWLLQNKGKKFFLVGSDYVFPRTANTIIKAQLAAKGGETVGEDYLPLGNTEVTPIITRIRNALPDGGVIFNTLNGDSNVAFFKQLQGAGLTPDKYPTMSVSIAEEEVQAIGVEYLKGHYAAWNYFMTVDTPENKSFVEAFKAKFGQNRVTNDPMEAAYIAVHLWKQAVEQAGTADDLEKVRQAAIGQTFNAPEGPVKMFANHHISKTVRIGEVGEDGLFKIVYSTPQPVDPLPWNQFVAETKGFACDWTRTDVDNPGKFKAAGA

SEQ ID NO: 12 - protein, 409 aa, Artificial Sequence
  mpUBP1 (with signal peptide replaced with M and a GGSHHHHHH at C-terminus, and also comprising C75A, C385A, and C395A mutations)
MKVGVLHSLSGTMAISETTLKDTVLMMVEEQNKKGGLLGKKLEAVVVDPASNWPLFAEKARELLTEDQVDVIFGAWTSVSRKSVLPVIEELNGLMFYPVQYEGEESSYNVFYTGAAPNQQAIPAVNYLKDELGVERWVLAGTDYVYPRTTNKILEAYLKDMGVAEDDIMINYTPFGHSDWQSIVSDIKKFGSAGKKTAVVSTINGDANVPFYKELGNQGISSEDIPVVAFSVGEEELSGLDTAPLVGHLAAWNYFQSVETDENEEFITKWQAYTKNPERVTNDPMEATFIGFNMWANAVTEAGTTDVDAVEKAMIGQETPNLTGGIAVMNKNHHLSKPVLIGEIQDDGQFETVWETDGVVPGDAWSDFLPGSKDLVADWTDPLKAGNYNTETKMASGQNYGGSHHHHHH

SEQ ID NO: 13 - protein, 414 aa, Artificial Sequence
  mhUBP2 (with signal peptide replaced with M and a GGSHHHHHH at C-terminus, and also comprising C385A and C395A mutations)
MKVGILHSLSGTMAISETALKDTMLMLIEKQNEAGGVLGRQLEPVVVDPASNWPLFAEKARELLEKEKVDVIFGNWTSVSRKSVLPVVEELNGLLFYPVQYEGEESSENVFYTGAAPNQQAIPAVDYLMNDLGVERWVLAGTDYVYPRTTNKILETYLKDKGVAAGDIMINYTPFGHSDWQTIVSDIKKFGSAGKKTAVVSTINGDANVPFYRELGNQGISATDIPVVAFSVGEQELSGIDTAPLVGHLAAWNYFMSVDNDANYDFIDAWVAYKGDDAAVTNDPMEAHYIGFNMYVEAVKKAGTTDVDEVKDAIIGVSVPNLTGGYATMMPNHHITKPVLIGEIQDNGQFSVVWETPSTVAGDAWSDFLPGSKDLISDWRAPLRAGNFNVVTGKAGGGSADVASNGGSHHHHHH

SEQ ID NO: 14 - protein, 378 aa, Artificial Sequence
  bsUBP3 (with signal peptide replaced with M and a GGSHHHHHH at C-terminus)
MKVGILHSLSGTMAISEVSVHDAELIAIQEINQKGGVLGKKLEPVVEDGASDWPTYAEKMRKLLQQDKVAAVFGGWTSASRKAMLPVVEQNNGLLFYPVQYEGMETSPNIFYTGATTNQQIVPAVDWLLKNKGKKFFLIGSDYVFPRTANKIIKAQVKAGGGEIAGEEYTPLGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSKGGSHHHHHH

SEQ ID NO: 15 - protein, 380 aa, Artificial Sequence
  dcUBP4 (with signal peptide replaced with M and a GGSHHHHHH at C-terminus)
MTIKVGILHSLSGTMAISEVSVKDAELMAIEEINASGGLLGKKIEPVIEDGASDWPTFAEKAKKLLQQDKVAVIFGGWTSASRKAMLPVVEENNGLLFYPVQYEGLESSPNIFYTGAEPSQQIVPAVSWLLENRGKKFYLLGSDYVFPRTANKIIKAQLKAKGGEVVGEEYTPLGHTDYSTIINKIKAAKPEIIFNTLNGDSNVAFFKQLKDAGITSKDITVMSVSIAEEEIRGIGPQNIAGHLAVWNYFQTTDTPENKEFVKKFKTKYGQDRVTDDPIEAGYFGVYLWAEAVKKANSTDVGKVKEAIKTVEFQAPEGLVKINGENQHTWKTVRIGEVQPDGQFKELWNSGGPVKPDPYLKGYEWAKGLSNGGSHHHHHH

SEQ ID NO: 16 - protein, 401 aa, Artificial Sequence
  gtUBP5 (with signal peptide replaced with M and a GGSHHHHHH at C-terminus)
MASSAVDEVKEKPKETSASETGDTVKVGILHSLSGTMAISEVSLRDAELMAIEEINKSGGLLGKKIEPVIEDGASDWPTFAEKAKKLLQKDKVAAIFGGWTSASRKAMLPVVEQNNGLLWYPVQYEGMESSPNIFYTGATTNQQIVPAVSWLLENRGKRFFLLGSDYVFPRTANKIIKAQLKAEGGQLVGEEYTPLGHTDYSTIINKIKEVKPDVVFNTLNGDSNVAFFKQLKDAGITAKDVTVMSVSIAEEEIRGIGGDVLAGHLAVWNYFQSTDTPENKAFVEKYKKKYGKERVTDDPIEAAYFAVHLWAEAVKKAGSFDVDKVKKAADGIEYKAPGGTVKIDGETQHTWKIVRIGEIQANGQFKELWNSGKAVKPDPYLKSYPWAKNLNGGSHHHHHH

SEQ ID NO: 17 - protein, 397 aa, Artificial Sequence
  ctUBP6 (with signal peptide replaced with M and a GGSHHHHHH at C-terminus)
MVEEPVDNKPGTDTSAEDTIKVGILHSLSGTMAISEVSLKDAELMAIEEINQAGGLLGKKIEPVIEDGASDWPTFAEKAKKLLQNDKVATVFGCWTSASRKAVLPVFEENNGLLWYPVQYEGMESSPNIFYTGAAPNQQIVPAVEWLLENKGKRFFLLGSDYVFPRTANKIIKAQLSAIGGELIAEEYTPLGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSDGGSHHHHHH

SEQ ID NO: 18 - protein, 393 aa, Artificial Sequence
  csUBP7 (with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 19 - protein, 413 aa, Artificial Sequence
  taUBP8 (with signal peptide replaced with M and a GGSHHHHHH at C-terminus, and also comprising C141A and C402A substitutions)
MKSGYANRRDFIKASAAVITLHTIAPALVWPSPKKIKVGVLHSLSGTMAISEVHVKNATLLAIEEINRKGGVLGYTIEPIIEDGASDPATFAQKAQKLILMDKVVTVFGGWTSASRKAMLPVFERYKNLLWYPVQFEGNEASPNIIYTGAQPNQQILPALEWALKQGYKKFFLVGSDYVFPRTANLILKKHIQKNGAIVSGEEYVPLGGTDFSAVVNKIINTKPDIVFNTINGDSNVAFFKQMAAAGVGPKVLPVISFSIAEQEAKAIGIPLLEGSYAAWNYFMSLNNKANLEFIKAYQGKYGKSSLITDPMAHGYMNVYLWKMAVEKAGTFDPMMVRKAATELPWVDSPFGKIKIAKNQSLYQTAYIGKLGSDGQFSIVWSSGKPIEPEPYDKLVFPGKKAVLGGSHHHHHH

SEQ ID NO: 20 - protein, 511 aa, Artificial Sequence
  gkUBP10 (with signal peptide replaced with M, which is followed by a FATT domain, followed by a sequence fragment for C3 protease, and with a GGSHHHHHH at C-terminus)
MAEESDNVDSADAEEDDSDVWWGGADTDYADGSEDKVVEVAEEEEVAEVEEEEADDDEDDEDGDEVEEEAEEPYEEATERTTSIATTTTTTTESVEEVLEVLFQGPASSAVDQAKNENKKDSSSASKEGDTVKVGILHSLSGTMAISEVSLRDAELMAIEEINASGGLLGKKIEPVVEDGASDWPTFAEKAKKLLQKDQVAAIFGGWTSASRKAMLPVVEQNNGLLWYPVQYEGMESSPNIFYTGATTNQQIVPAVSWLLKNRGKTFFLLGSDYVFPRTANKIIKAQLKAEGGQVVGEEYTPLGHTDYSTIISKIKQVKPAVVFNTLNGDSNVAFFKQLKDAGITPKDVTVMSVSIAEEEIRGIGPDVLAGHLAVWNYFQTTDTPENKAFVQKYKEKYGQDRVTDDPIEAAYTAVHLWAEAVKKAGSFDVDQVKKAAAGLEYKAPEGTVKIDGETQHLWKTVRIGEIQADGQFKELWNSGQPVKPDPYLKSYPWAKGLSEGGSHHHHHHHH

SEQ ID NO: 21 - protein, 507 aa, Artificial Sequence
  psUBP11 (with signal peptide replaced with M, which is followed by a FATT domain, followed by a sequence fragment for C3 protease, and with a GGSHHHHHH at C-terminus)
MAEESDNVDSADAEEDDSDVWWGGADTDYADGSEDKVVEVAEEEEVAEVEEEEADDDEDDEDGDEVEEEAEEPYEEATERTTSIATTTTTTTESVEEVLEVLFQGPKETAPTAGAGNGSPPVEAAGDSIKVGILHSLSGTMAISEVSVKDAEMLAIEEINAAGGVLGKQIEPVIEDGASDWPTFAEKAGKLLQQDKVAAVFGGWTSASRKAMLPVFEQNHGLLFYPVQYEGLESSPNIFYTGATTNQQIVPSVSWLLENRGKKMFLLGSDYVFPRTANKIIKAQLTAEGGELAGEEYTPLGHTDFSTIIAKIKEAKPDIVYNTLNGDSNVAFFKQLKDAGTTSKDMTTLSVSVAEEEIRGIGADILEGHLAAWNYYQSTDTPENKAFVDKYKAKYGADRVTADPIEAGYTAVYLWKAAVEKAGTTDVDKVKEAAKGIEFAAPEGKVTIDGDNQHIHKTVRIGEVQADGQFKELWNSGEPVKPDPYLKTYDWAKGLSGEGGSHHHHHH

SEQ ID NO: 22 - protein, 508 aa, Artificial Sequence
  teUBP12 (with signal peptide replaced with M, which is followed by a FATT domain, followed by a sequence fragment for C3 protease, and with a GGSHHHHHH at C-terminus, as well as C185A, C216A, and C481A mutations)
MAEESDNVDSADAEEDDSDVWWGGADTDYADGSEDKVVEVAEEEEVAEVEEEEADDDEDDEDGDEVEEEAEEPYEEATERTTSIATTTTTTTESVEEVLEVLFQGPGGDTIKVGILHSLSGTMAISEKSVVDATQLAIEQINQAGGVLGKQIQPILEDGASDWPTFAEKATKLIDQDKVVAVFGAWTSASRKAVLPVFESKNHMLWYPVQYEGQEASKNIFYTGAAPNQQIEPAVDWLLQNKGKKFFLVGSDYVFPRTANTIIKAQLAAKGGETVGEDYLPLGNTEVTPIITRIRNALPDGGVIFNTLNGDSNVAFFKQLQGAGLTPDKYPTMSVSIAEEEVQAIGVEYLKGHYAAWNYFMTVDTPENKSFVEAFKAKFGQNRVTNDPMEAAYIAVHLWKQAVEQAGTADDLEKVRQAAIGQTFNAPEGPVKMFANHHISKTVRIGEVGEDGLFKIVYSTPQPVDPLPWNQFVAETKGFAADWTRTDVDNPGKFKAAGAGGSHHHHHH

SEQ ID NO: 23 - protein, 393 aa, Artificial Sequence
  csUBP7_26C (26C  substitution mutant with signal peptide replaced with M and a GGSHHHHHH at C-terminus, and also comprising a C89A substitution)
MSSSESEKEKSEETIKVGILHSLSGCMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 24 - protein, 393 aa, Artificial Sequence
  csUBP7_27C (27C substitution mutant with signal peptide replaced with M and a GGSHHHHHH at C-terminus, and also comprising a C89A substitution)
MSSSESEKEKSEETIKVGILHSLSGTCSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 25 - protein, 393 aa, Artificial Sequence
  csUBP7_30C (30C substitution mutant with signal peptide replaced with M and a GGSHHHHHH at C-terminus, and also comprising a C89A substitution)
MSSSESEKEKSEETIKVGILHSLSGTMSICEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 26 - protein, 393 aa, Artificial Sequence
  csUBP7_65C (65C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGACDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 27 - protein, 393 aa, Artificial Sequence
  csUBP7_69C (69C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPCFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 28 - protein, 393 aa, Artificial Sequence
  csUBP7_90C (90C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGACTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 29 - protein, 393 aa, Artificial Sequence
  csUBP7_91C (91C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWCSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 30 - protein, 393 aa, Artificial Sequence
  csUBP7_92C (92C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTCASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 31 - protein, 393 aa, Artificial Sequence
  csUBP7_93C (93C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSCSRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 32 - protein, 393 aa, Artificial Sequence
  csUBP7_95C (95C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASCKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 33 - protein, 393 aa, Artificial Sequence
  csUBP7_111C (111C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFCPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 34 - protein, 393 aa, Artificial Sequence
  csUBP7_114C (114C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVCYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 35 - protein, 393 aa, Artificial Sequence
  csUBP7_115C (115C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQCEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 36 - protein, 393 aa, Artificial Sequence
  csUBP7_116C (116C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYCGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 37 - protein, 393 aa, Artificial Sequence
  csUBP7_157C (157C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDCVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 38 - protein, 393 aa, Artificial Sequence
  csUBP7_158C (158C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYCFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 39 - protein, 393 aa, Artificial Sequence
  csUBP7_159C (159C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVCPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 40 - protein, 393 aa, Artificial Sequence
  csUBP7_186C (186C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 41 - protein, 393 aa, Artificial Sequence
  csUBP7_211C (211C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLCGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 42 - protein, 393 aa, Artificial Sequence
  csUBP7_238C (238C substitution mutant with signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVCIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 43 - protein, 378 aa, Artificial Sequence
  bsUBP3_76C (76C substitution mutant with signal peptide replaced with M and a GGSHHHHHH at C-terminus)
MKVGILHSLSGTMAISEVSVHDAELIAIQEINQKGGVLGKKLEPVVEDGASDWPTYAEKMRKLLQQDKVAAVFGGCTSASRKAMLPVVEQNNGLLFYPVQYEGMETSPNIFYTGATTNQQIVPAVDWLLKNKGKKFFLIGSDYVFPRTANKIIKAQVKAGGGEIAGEEYTPLGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSKGGSHHHHHH

SEQ ID NO: 44 - protein, 378 aa, Artificial Sequence
  bsUBP3_77C (77C substitution mutant with signal peptide replaced with M and a GGSHHHHHH at C-terminus)
MKVGILHSLSGTMAISEVSVHDAELIAIQEINQKGGVLGKKLEPVVEDGASDWPTYAEKMRKLLQQDKVAAVFGGWCSASRKAMLPVVEQNNGLLFYPVQYEGMETSPNIFYTGATTNQQIVPAVDWLLKNKGKKFFLIGSDYVFPRTANKIIKAQVKAGGGEIAGEEYTPLGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSKGGSHHHHHH

SEQ ID NO: 45 - protein, 378 aa, Artificial Sequence
  bsUBP3_78C (78C substitution mutant with signal peptide replaced with M and a GGSHHHHHH at C-terminus)
MKVGILHSLSGTMAISEVSVHDAELIAIQEINQKGGVLGKKLEPVVEDGASDWPTYAEKMRKLLQQDKVAAVFGGWTCASRKAMLPVVEQNNGLLFYPVQYEGMETSPNIFYTGATTNQQIVPAVDWLLKNKGKKFFLIGSDYVFPRTANKIIKAQVKAGGGEIAGEEYTPLGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSKGGSHHHHHH

SEQ ID NO: 46 - protein, 378 aa, Artificial Sequence
  bsUBP3_79C (79C substitution mutant with signal peptide replaced with M and a GGSHHHHHH at C-terminus)
MKVGILHSLSGTMAISEVSVHDAELIAIQEINQKGGVLGKKLEPVVEDGASDWPTYAEKMRKLLQQDKVAAVFGGWTSCSRKAMLPVVEQNNGLLFYPVQYEGMETSPNIFYTGATTNQQIVPAVDWLLKNKGKKFFLIGSDYVFPRTANKIIKAQVKAGGGEIAGEEYTPLGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSKGGSHHHHHH

SEQ ID NO: 47 - protein, 378 aa, Artificial Sequence
  bsUBP3_145C (145C substitution mutant with signal peptide replaced with M and a GGSHHHHHH at C-terminus)
MKVGILHSLSGTMAISEVSVHDAELIAIQEINQKGGVLGKKLEPVVEDGASDWPTYAEKMRKLLQQDKVAAVFGGWTSASRKAMLPVVEQNNGLLFYPVQYEGMETSPNIFYTGATTNQQIVPAVDWLLKNKGKKFFLIGSDYVCPRTANKIIKAQVKAGGGEIAGEEYTPLGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSKGGSHHHHHH

SEQ ID NO: 48 - protein, 378 aa, Artificial Sequence
  bsUBP3_172C (172C substitution mutant with signal peptide replaced with M and a GGSHHHHHH at C-terminus)
MKVGILHSLSGTMAISEVSVHDAELIAIQEINQKGGVLGKKLEPVVEDGASDWPTYAEKMRKLLQQDKVAAVFGGWTSASRKAMLPVVEQNNGLLFYPVQYEGMETSPNIFYTGATTNQQIVPAVDWLLKNKGKKFFLIGSDYVFPRTANKIIKAQVKAGGGEIAGEEYTPCGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSKGGSHHHHHH

SEQ ID NO: 49 - protein, 397 aa, Artificial Sequence
  ctUBP6_95C (95C substitution mutant with signal peptide replaced with M and a GGSHHHHHH at C-terminus)
MVEEPVDNKPGTDTSAEDTIKVGILHSLSGTMAISEVSLKDAELMAIEEINQAGGLLGKKIEPVIEDGASDWPTFAEKAKKLLQNDKVATVFGCCTSASRKAVLPVFEENNGLLWYPVQYEGMESSPNIFYTGAAPNQQIVPAVEWLLENKGKRFFLLGSDYVFPRTANKIIKAQLSAIGGELIAEEYTPLGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSDGGSHHHHHH

SEQ ID NO: 50 - protein, 397 aa, Artificial Sequence
  ctUBP6_96C (96C substitution mutant with signal peptide replaced with M and a GGSHHHHHH at C-terminus)
MVEEPVDNKPGTDTSAEDTIKVGILHSLSGTMAISEVSLKDAELMAIEEINQAGGLLGKKIEPVIEDGASDWPTFAEKAKKLLQNDKVATVFGCWCSASRKAVLPVFEENNGLLWYPVQYEGMESSPNIFYTGAAPNQQIVPAVEWLLENKGKRFFLLGSDYVFPRTANKIIKAQLSAIGGELIAEEYTPLGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSDGGSHHHHHH

SEQ ID NO: 51 - protein, 397 aa, Artificial Sequence
  ctUBP6_97C (97C substitution mutant with signal peptide replaced with M and a GGSHHHHHH at C-terminus)
MVEEPVDNKPGTDTSAEDTIKVGILHSLSGTMAISEVSLKDAELMAIEEINQAGGLLGKKIEPVIEDGASDWPTFAEKAKKLLQNDKVATVFGCWTCASRKAVLPVFEENNGLLWYPVQYEGMESSPNIFYTGAAPNQQIVPAVEWLLENKGKRFFLLGSDYVFPRTANKIIKAQLSAIGGELIAEEYTPLGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSDGGSHHHHHH

SEQ ID NO: 52 - protein, 397 aa, Artificial Sequence
  ctUBP6_98C (98C substitution mutant with signal peptide replaced with M and a GGSHHHHHH at C-terminus)
MVEEPVDNKPGTDTSAEDTIKVGILHSLSGTMAISEVSLKDAELMAIEEINQAGGLLGKKIEPVIEDGASDWPTFAEKAKKLLQNDKVATVFGCWTSCSRKAVLPVFEENNGLLWYPVQYEGMESSPNIFYTGAAPNQQIVPAVEWLLENKGKRFFLLGSDYVFPRTANKIIKAQLSAIGGELIAEEYTPLGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSDGGSHHHHHH

SEQ ID NO: 53 - protein, 397 aa, Artificial Sequence
  ctUBP6_164C (164C substitution mutant with signal peptide replaced with M and a GGSHHHHHH at C-terminus)
MVEEPVDNKPGTDTSAEDTIKVGILHSLSGTMAISEVSLKDAELMAIEEINQAGGLLGKKIEPVIEDGASDWPTFAEKAKKLLQNDKVATVFGCWTSASRKAVLPVFEENNGLLWYPVQYEGMESSPNIFYTGAAPNQQIVPAVEWLLENKGKRFFLLGSDYVCPRTANKIIKAQLSAIGGELIAEEYTPLGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSDGGSHHHHHH

SEQ ID NO: 54 - protein, 397 aa, Artificial Sequence
  ctUBP6_191C (191C substitution mutant with signal peptide replaced with M and a GGSHHHHHH at C-terminus)
MVEEPVDNKPGTDTSAEDTIKVGILHSLSGTMAISEVSLKDAELMAIEEINQAGGLLGKKIEPVIEDGASDWPTFAEKAKKLLQNDKVATVFGCWTSASRKAVLPVFEENNGLLWYPVQYEGMESSPNIFYTGAAPNQQIVPAVEWLLENKGKRFFLLGSDYVFPRTANKIIKAQLSAIGGELIAEEYTPCGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSDGGSHHHHHH

SEQ ID NO: 55 - protein, 393 aa, Artificial Sequence
  csUBP7_186C.1  (186C, 43Q, 276N, 280M substitution mutant, signal peptide replaced with M and a GGSHHHHHH at C-terminus, and also comprising a C89A substitution)
MSSSESEKEKSEETIKVGILHSLSGTMSISEVSLKDAELMAIQEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVENYKKMYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 56 - protein, 393 aa, Artificial Sequence
  csUBP7_186C.2  (186C, 288S substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTSDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 57 - protein, 393 aa, Artificial Sequence
  csUBP7_186C.3  (186C, 329G substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPGGPVKIDGDNQHLYKTVRIGEILENGQIRELWKTNKPVKPDPYLKGYEWAQGLSEQGGSHHHHHH

SEQ ID NO: 58 - protein, 393 aa, Artificial Sequence
  csUBP7_186C.4  (186C, 116Q substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYQGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 59 - protein, 393 aa, Artificial Sequence
  csUBP7_186C.5  (186C, 116D substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYDGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 60 - protein, 393 aa, Artificial Sequence
  csUBP7_186C.6  (186C, 116A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYAGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 61 - protein, 393 aa, Artificial Sequence
  csUBP7_186C.7  (186C, 30I, 241A substitution mutant, signal peptide replaced with M and a GGSHHHHHH at C-terminus, and also comprising a C89A substitution)
MSSSESEKEKSEETIKVGILHSLSGTMSIIEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAAEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 62 - protein, 393 aa, Artificial Sequence
  csUBP7_186C.8  (186C, 211S substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLSGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 63 - protein, 393 aa, Artificial Sequence
  csUBP7_186C.9  (186C, 114S substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVSYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 64 - protein, 393 aa, Artificial Sequence
  csUBP7_186C.10  (186C, 114N substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVNYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 65 - protein, 393 aa, Artificial Sequence
  csUBP7_186C.11  (186C, S92A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTAASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 66 - protein, 393 aa, Artificial Sequence
  csUBP7_186C.12  (186C, Y111A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFAPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 67 - protein, 393 aa, Artificial Sequence
  csUBP7_186C.13  (186C, Y157A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDAVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 68 - protein, 393 aa, Artificial Sequence
  csUBP7_186C.14  (186C, F159A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVAPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 69 - protein, 393 aa, Artificial Sequence
  csUBP7_186C.15  (186C, 113A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPAQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 70 - protein, 393 aa, Artificial Sequence
  csUBP7_186C.16  (186C, 113T substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPTQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 71 - protein, 393 aa, Artificial Sequence
  csUBP7_186C.17  (186C, 113N substitution mutant, signal peptide replaced with M and a GGSHHHHHH at C-terminus, and also comprising a C89A substitution
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPNQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 72 - protein, 393 aa, Artificial Sequence
  csUBP7_186C.18  (186C, 113Q substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPQQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 73 - protein, 393 aa, Artificial Sequence
  csUBP7_186C.19  (186C, 113H substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPHQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 74 - protein, 393 aa, Artificial Sequence
  csUBP7_186C.20  (186C, 114A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVAYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 75 - protein, 393 aa, Artificial Sequence
  csUBP7_186C.21  (186C, 114D substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVDYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 76 - protein, 393 aa, Artificial Sequence
  csUBP7_186C.22  (186C, 114E substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVEYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 77 - protein, 393 aa, Artificial Sequence
  csUBP7_186C.23  (186C, 114H substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVHYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 78 - protein, 393 aa, Artificial Sequence
  csUBP7_186C.24  (186C, 114T substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVTYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 79 - protein, 393 aa, Artificial Sequence
  csUBP7_186C.25  (186C, 114Y substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVYYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 80 - protein, 393 aa, Artificial Sequence
  csUBP7_186C.26  (186C, 114M substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVMYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 81 - protein, 393 aa, Artificial Sequence
  csUBP7_186C.27  (186C, 114L substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVLYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 82 - protein, 393 aa, Artificial Sequence
  csUBP7_186C.28  (186C, 211A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLAGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 83 - protein, 393 aa, Artificial Sequence
  csUBP7_186C.29  (186C, 211Q substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLQGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 84 - protein, 393 aa, Artificial Sequence; identical to SEQ ID NO: 62
  csUBP7_186C.30  (186C, 211S substitution mutant, signal peptide replaced with M and a GGSHHHHHH at C-terminus, and also comprising a C89A substitution)

SEQ ID NO: 85 - protein, 393 aa, Artificial Sequence
  csUBP7_186C.31  (186C, 211D substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLDGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 86 - protein, 393 aa, Artificial Sequence
  csUBP7_186C.32  (186C, 211E substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLEGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 87 - protein, 393 aa, Artificial Sequence
  csUBP7_186C.33  (186C, 211H substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLHGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 88 - protein, 393 aa, Artificial Sequence
  csUBP7_186C.34  (186C, 211T substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLTGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 89 - protein, 393 aa, Artificial Sequence
  csUBP7_186C.35  (186C, 211L substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLLGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 90 - protein, 393 aa, Artificial Sequence
  csUBP7_186C.36  (186C, 238A substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVAIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 91 - protein, 393 aa, Artificial Sequence
  sUBP7_186C.37  (186C, 238N substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVNIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 92 - protein, 393 aa, Artificial Sequence
  csUBP7_186C.38  (186C, 238Q substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVQIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 93 - protein, 393 aa, Artificial Sequence
  csUBP7_186C.39  (186C, 238H substitution mutant, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVHIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 94 - protein, 417 aa, Artificial Sequence
  csUBP7_26C_bZif (26C substitution mutant, with bZif fusion, signal peptide replaced with M and a GGSHHHHHH at C-terminus, and also comprising a C89A substitution)
MSSSESEKEKSEETIKVGILHSLSGCMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSGGSTGEKPYKCPECGKSFSRSGGSHHHHHH

SEQ ID NO: 95 - protein, 417 aa, Artificial Sequence
  csUBP7_27C_bZif (27C substitution mutant, with bZif fusion, signal peptide replaced with M and a GGSHHHHHH at C-terminus, and also comprising a C89A substitution)
MSSSESEKEKSEETIKVGILHSLSGTCSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSGGSTGEKPYKCPECGKSFSRSGGSHHHHHH

SEQ ID NO: 96 - protein, 417 aa, Artificial Sequence
  csUBP7_30C_bZif (30C substitution mutant, with bZif fusion, signal peptide replaced with M and a GGSHHHHHH at C-terminus, and also comprising a C89A substitution)
MSSSESEKEKSEETIKVGILHSLSGTMSICEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSGGSTGEKPYKCPECGKSFSRSGGSHHHHHH

SEQ ID NO: 97 - protein, 417 aa, Artificial Sequence
  csUBP7_95C_bZif (95C substitution mutant, with bZif fusion, signal peptide replaced with M and a GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASCKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSGGSTGEKPYKCPECGKSFSRSGGSHHHHHH

SEQ ID NO: 98 - protein, 417 aa, Artificial Sequence
  csUBP7_186C.20_bZif (186C, 114A, substitution mutant, with bZIf fusion, signal peptide replaced with M and GGSHHHHHH at C-terminus, and also comprising a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVAYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSGGSTGEKPYKCPECGKSFSRSGGSHHHHHH

SEQ ID NO: 99 - protein, 402 aa, Artificial Sequence
  csUBP7_186C.114A_Imm1
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVAYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSKKKKKKGGSHHHHHH

SEQ ID NO: 100 - protein, 402 aa, Artificial Sequence
  csUBP7_186C.114A_Imm2
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVAYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHHGGSKKKKKK

SEQ ID NO: 101 - protein, 406 aa, Artificial Sequence
  csUBP7_186C.114A_Imm3
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVAYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHHGGSKKKKKKKKKK

SEQ ID NO: 102 - protein, 401 aa, Artificial Sequence
  csUBP7_186C.114A_Imm4
MKKKKKKGGSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVAYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 103 - protein, 405 aa, Artificial Sequence
  csUBP7_186C.114A_Imm5
MKKKKKKKKKKGGSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVAYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSHHHHHH

SEQ ID NO: 104 - protein, 431 aa, Artificial Sequence
  csUBP7_186C.114A_Imm6
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVAYEGLESSPNIFYMGAAPNQQIVPAVKWLFDNGKKRFYLLGSDYVFPRTANKIIKAYLKYLGGVVVGEEYTPCGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQGGSGGSTGEKPYKCPECGKSFSRSDHLSRHQRTHQNKKGGSHHHHHH

SEQ ID NO: 105 - protein, 18 aa, Artificial Sequence
  bZif
TGEKPYKCPECGKSFSRS

SEQ ID NO: 106 - protein, 32 aa, Artificial Sequence
  ZF-QNK
TGEKPYKCPECGKSFSRSDHLSRHQRTHQNKK

SEQ ID NO: 107 - protein, 6 aa, Artificial Sequence
  Hexahistidine Tag
HHHHHH

SEQ ID NO: 108 - protein, 6 aa, Artificial Sequence
  Hexalysine Tag
KKKKKK

SEQ ID NO: 109 - DNA, 1631 bp, Artificial Sequence
  Exemplary nucleotide sequence encoding mpUBP1
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggtgtattacattcattatcaggtactatggccatttccgaaacaacgctgaaagataccgtattaatgatggtcgaggagcaaaataagaaggggggcctcctgggcaagaagttggaagctgtagtcgtcgacccggcatcaaattggccactctttgccgaaaaagcacgtgaactgttgacagaagaccaagtggacgtaattttcggggcctggacatctgtcagccgcaaatcagtactcccggtgattgaggaattaaatggtcttatgttttatccggtccaatacgagggggaagagtcgtcctataacgtattttataccggggcagccccgaatcaacaggctatccctgccgtcaactacctcaaagacgaattgggtgtcgaacgttgggtcctcgccgggacagactatgtctatccacggactacgaataagattctcgaagcgtacctcaaggatatgggcgtcgcggaagatgatattatgattaattacacaccattcggccactccgattggcaaagtattgtctcagatatcaaaaagttcggctccgcagggaagaagactgcagtagtatccaccattaacggtgacgctaatgtgccattttacaaggagttaggtaaccagggcatttcgtcagaggacattccagtggtcgccttcagcgtcggtgaggaagagctctcaggccttgataccgcaccactggtgggccatctggctgcgtggaattacttccaatctgtagagactgacgagaacgaggagttcattacaaagtggcaagcctatacaaaaaatcctgaacgcgtcacaaatgacccaatggaagcaaccttcatcggctttaatatgtgggcaaacgcagtaacagaagcgggtaccacagatgtagatgccgtcgagaaggctatgattgggcaggagacaccaaatctgacagggggcattgcagtaatgaacaagaaccaccacttgagtaaaccagtccttatcggtgaaatccaggatgacgggcagttcgagacagtgtgggaaacagatggtgtggtcccaggggatgcatggtccgacttcttgccaggctcaaaagatcttgtcgccgattggacggatccattgaaggccgggaactacaatacggaaaccaagatggcatcaggtcagaattatggcggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 110 - DNA, 1646 bp, Artificial Sequence
  Exemplary nucleotide sequence encoding mhUBP2
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggcattttacattctttatcaggtactatggccatctctgagacagcccttaaggacactatgcttatgttaatcgaaaaacaaaacgaagcaggtggggtcctgggtcgtcaacttgaaccagtcgtagtagatcctgcatcaaattggccactcttcgctgaaaaggcacgtgaacttcttgagaaagagaaagtcgacgtaatcttcggtaactggacatcagtgagtcgtaaatccgtacttcctgtcgtcgaggaattaaatggtctcttattctatccggtccaatacgaaggtgaagaaagcagtgagaatgtgttctacacaggcgccgctccgaaccaacaggcgatccctgcagtagattacctgatgaatgaccttggtgtcgagcggtgggtcttagcaggcacggactacgtataccctcgtaccactaataaaatcttagagacatacttgaaagacaagggcgttgcagccggtgatatcatgattaattataccccgttcgggcatagcgactggcaaacgattgtaagcgacatcaagaaatttgggagtgccggcaaaaaaacggcagtcgtaagcacaatcaacggtgatgcaaacgttccattttaccgggaattaggtaatcaggggatctctgcaacagatattccagtagtagccttttccgtaggtgagcaggagctcagcggtatcgacaccgcaccattggtaggtcatttagccgcctggaattatttcatgtccgtagacaacgatgccaactacgattttattgatgcatgggtcgcttacaaaggggacgacgccgccgtcacgaatgacccaatggaagcacactatatcgggtttaacatgtacgtggaagccgtaaagaaagcgggtacaaccgacgtggatgaggtcaaagacgcaatcatcggtgtatcagttcctaacttaaccggcggctacgcaaccatgatgcctaaccaccatatcaccaagccagtattaatcggtgagatccaagacaatggtcagttcagcgtggtctgggagacaccgtcaacagtcgcaggtgacgcatggtcagatttccttcctggtagtaaagatttaatttcagattggcgtgcaccactccgtgcggggaatttcaatgtcgtgacaggcaaagcaggtgggggcagtgcagatgtagcatcaaatggcggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 111 - DNA, 1538 bp, Artificial Sequence
  Exemplary nucleotide sequence encoding bsUBP3
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggcattttgcattctttatcaggtaccatggcaatctcggaagtaagtgttcacgacgccgagctcattgcgatccaagaaatcaatcagaaggggggtgtcctcggtaagaaactcgaaccggtagtggaagatggtgcatccgactggcctacatatgcagagaaaatgcggaagctcttacagcaggataaagtagcagcagtattcggcgggtggacctccgcgtcgcgtaaggcaatgcttccagtagtcgagcaaaataacgggctcttattttacccagtccagtacgaagggatggagacatcgccaaatatcttctatactggtgcaacaaccaaccaacaaatcgtcccagccgtagattggcttttgaagaataaagggaaaaaattcttcctcatcggtagtgactacgtcttcccgcgtaccgccaacaagattatcaaagcccaggtcaaagcggggggcggcgaaattgcgggtgaggagtacaccccattgggccacactaattattcaacactggtatccaaaatcaaggaaaaacaaccagatgtaatctttaatacactcaacggggactctaacgttgccttctttaagcagctcaaggatgcagggatcagcgctgacgatatgccggtaatgagcgcatctgtcgccgaggaggagatccgggggattgggccagacgtactcaaggggcattatgccgtgtggaactactttcaaactactaacaccagtgagaaccaaacattcgtcaaaaattataaaaagatgaacggtgacagccgcgtaactagcgatccaattgaggccgggtataacgcagtctatctctgggcggccgcagtagaaaaagctaagagttttgacgtggacaaggtcaagaaagccgcagatggtattagtttcaaggccccaggtggcaccgtaaagatcgatggtgatactcagcacttatataagaccgtacgcatcgggcagattacgggggatggtcagttcaaagaggtatggaatagtggtgaaccagtgaagccagatccgtatttgaagacctatgattgggcaaagggcctctccaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 112 - DNA, 1544 bp, Artificial Sequence
  Exemplary nucleotide sequence encoding dcUBP4
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgacaattaaagtaggtattcttcattctttatcaggtacgatggctatctctgaagtatcagtcaaagatgccgaactcatggcaatcgaagaaattaacgcgtctggcggtctgctcggtaaaaagattgaacctgtaatcgaagatggtgcctcagattggccaaccttcgcagagaaggcaaagaagctcctgcaacaggacaaggtagcggtgatctttggcgggtggacatcagcctcgcggaaggccatgcttccagtagttgaggaaaacaacggtctcttattctatccagtccagtacgagggcctggaaagttcccctaacatcttttacactggtgcagagccgtcacagcagatcgtcccggccgtatcctggcttctggagaatcgtggcaaaaaattctaccttctcgggtccgattatgtctttccgcgcactgcgaataagatcatcaaggctcaactcaaagccaaaggcggtgaagtggtaggcgaggagtatacccctttagggcacacagactactcaacgattattaataagatcaaagctgcgaagcctgagatcattttcaacaccctcaatggcgacagtaatgtagcatttttcaagcagttaaaagacgcgggcatcaccagcaaagatatcaccgtaatgagcgtcagcatcgccgaggaagaaatccgtgggatcgggccacagaatattgctggccatttagccgtatggaactactttcagactaccgatacgccagagaacaaggagttcgtgaaaaagttcaagacaaaatacggccaagatcgggtaactgacgaccctatcgaagccggctattttggcgtatatctgtgggcagaagctgtgaagaaagcgaactcaacggacgtcggtaaggtaaaggaagccatcaagacagtagagtttcaagccccggaaggtttagtcaaaatcaacggtgagaaccaacacacgtggaaaacagtgcggatcggtgaagtacagccagatggtcaattcaaagaactgtggaactcagggggtccagtcaaacctgacccatatttaaaaggttacgagtgggccaaagggctctcgaatggcggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 113 - DNA, 1607 bp, Artificial Sequence
  Exemplary nucleotide sequence encoding gtUBP5
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggcaagtagtgcagtagatgaagttaaagaaaagcctaaagaaactagtgcaagcgagaccggcgacaccgttaaggtcggcatcttacacagtctttctggcaccatggccatttccgaggtctcattacgggacgctgagctcatggcaattgaggagatcaataagtcagggggtctgctcggcaaaaagattgaaccagtaatcgaagacggcgcatcagactggcctacgttcgcggagaaagccaaaaagctcctgcagaaagataaggtagcggcgattttcggcgggtggaccagtgcatcacgtaaagcaatgttaccagtggtcgagcagaataacgggctcttatggtatccggtacagtacgaaggcatggaatcaagcccaaatatcttttatacgggtgcgaccacaaaccagcagattgtcccggccgtctcctggctcctcgagaaccgtggcaaacgcttttttttattgggtagcgattatgtattccctcggacagcaaataagatcattaaggcccagctgaaagccgagggggggcaactcgtaggggaagaatacacgccacttgggcacacggactactctaccatcattaacaaaattaaagaggtcaaacctgatgtagtcttcaacaccttgaatggtgattctaacgtagcctttttcaaacagctcaaggatgccggtatcaccgcaaaggacgtaacggtcatgagtgtaagcattgcagaagaagagattcgcgggatcggcggggatgtattagcaggtcacttagcagtctggaactactttcaaagtacagacacgccggagaataaagccttcgtagaaaaatacaaaaagaaatatggtaaagaacgcgtcacggacgaccctattgaggcggcgtatttcgcggtgcatttatgggcagaagcagtcaaaaaagccggctccttcgacgtcgataaggttaagaaagcggccgacgggattgaatacaaagcgcctggcggtacagtcaaaattgatggtgagacgcagcacacctggaaaattgtacgcatcggggagatccaagcaaacggtcagttcaaagagctctggaatagtgggaaggcagtcaaaccggatccttatctcaagtcgtacccatgggccaaaaatctgaatggcggttctcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 114 - DNA, 1595 bp, Artificial Sequence
  Exemplary nucleotide sequence encoding ctUBP6
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggttgaagaaccagtagataataaaccaggtaccgacacttcagcagaggacacgatcaaggtcggcattttacattcactgtctggcactatggcaatctccgaggtctccctcaaagatgccgaactcatggcaattgaagaaattaaccaagcaggtgggctcttaggtaaaaaaatcgaaccagtaattgaagacggggcctccgactggcctacattcgctgaaaaggcaaagaagttacttcaaaacgacaaagttgcaaccgtcttcggctgttggacatccgcatcgcgtaaagctgtcttgccagtcttcgaggagaacaacgggttactgtggtatccggtacaatacgagggcatggaatcaagcccaaacattttttacacaggggccgctccgaatcagcagattgtaccagcagtggaatggctcttagaaaataaaggcaaacggttctttctccttggctcggattacgtattcccacgcacggcaaataagattattaaggcgcagctgtccgcaatcgggggggagcttattgccgaggaatacactccattgggtcacaccgactatagtaccattgtcaacaaaatcaagacggcgaagccggatgtagtattcaacacattgaacggggactccaacgttgccttctttaaacagctcaaagacgcggggatcacctccgaagacattaccgtatgttcagtcagcgtcgccgaagaagaaattcgtggcatcggggccgaaaatattaaggggcacctcgttagttggaactactaccaaaccaccgacaccccggaaaataaggagttcgtcgagaagtataaatcgaaatatgggagcgaccgcgtcaccgatgatccaattgaggcagcctacatcgccgtacacttatgggcagaagcagtcaagaaagcagggtcgtttgaagtagagaaagtgaaagaggccgccaagggcttagagtttaaagcgcctgaagggttagtaaagatcgagggggagaatcagcatctctggaagccagtccgtattggtgaagtacaggaggacggtttaatcaaggagatctggtcgaccagcgaagcagtccgtccggacccttacttgaaaacttacgattgggccaaaggcctcagcgatgggggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 115 - DNA, 1583 bp, Artificial Sequence
  Exemplary nucleotide sequence encoding csUBP7
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 116 - DNA, 1643 bp, Artificial Sequence
  Exemplary nucleotide sequence encoding taUBP8
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaatcaggttatgctaatcgtcgcgactttatcaaagcgtccgccgcagtcatcaccttgcacacaattgcaccagcactcgtttggccaagtcctaagaagatcaaagtcggcgtactccacagtctgagtggtactatggccatctctgaggtccacgtcaagaacgcaacattgctcgccattgaggaaatcaatcgtaaaggcggcgtactcgggtataccattgaacctatcattgaagacggggcatcggacccagctaccttcgcacaaaaagcacaaaaattgattctcatggacaaagttgtaaccgtattcggtgggtggacgagcgcctcgcgtaaggcgatgttaccagtcttcgagcggtacaaaaacctgttatggtacccagtgcagttcgaagggaatgaagcctcaccaaatattatttacaccggtgcacaaccgaaccaacaaatcctcccggctttggagtgggcacttaagcaaggttataagaagtttttcctggtaggcagcgactatgtcttccctcgtaccgcgaatctgatcttgaagaagcatattcagaagaacggtgctatcgtcagcggcgaagaatatgtacctttaggggggacggacttcagtgccgttgtaaacaagatcatcaatacaaagccagacatcgtgttcaataccattaatggtgatagtaacgtagctttctttaaacaaatggcagcggcaggcgttggccctaaggtcctccctgtaattagcttcagcatcgcggaacaagaagcaaaggcaatcgggatcccattattggagggctcatacgcagcttggaactatttcatgtcgcttaataacaaggccaacctggagttcattaaggcttatcaaggcaagtatggtaaatcgtcattaatcacagatccaatggcacatggctatatgaatgtctacctctggaagatggcagtagaaaaggctggtaccttcgacccgatgatggtgcgcaaagcagccacagagctcccatgggtagactccccattcggtaaaattaaaatcgctaaaaatcagtccctctaccagaccgcttatatcggtaagctcggttcagatggtcaattttcaattgtgtggagtagcgggaaacctatcgagcctgagccatatgataaattagtattcccagggaagaaagcggtcttaggtggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 117 - DNA, 1937 bp, Artificial Sequence
  Exemplary nucleotide sequence encoding gkUBP10
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggctgaagaatcagataatgtagatagtgctgacgcagaagaggatgatagcgacgtatggtggggtggtgccgacaccgactacgcagatggtagcgaagacaaagtcgtggaagtcgcagaagaggaagaggttgctgaggtagaggaagaagaggcagacgacgacgaagatgacgaggacggtgatgaggtcgaagaagaagcggaagaaccgtatgaggaagccacagagcgcactacatcgatcgctacaacaaccaccactaccaccgaatcagttgaagaagtcctcgaggttctcttccaagggccggctagctccgcggtcgatcaggctaaaaacgaaaacaagaaggactcgtccagtgcgtccaaagaaggcgacacagtgaaagtagggatcttacactcgttatcaggcacaatggcaatttcggaggtttcgctccgcgatgcagaactgatggcaattgaagaaatcaatgcctccggcggcctcttgggtaaaaagattgaaccagtggtagaagatggcgcatctgactggccgacatttgcagagaaggcaaaaaaattactccaaaaagaccaggtagcagcaatcttcggcggttggacttccgcgtcccggaaagccatgctcccggtagtcgaacaaaataatggtctcctctggtacccagttcagtacgaaggcatggaatcatctccaaatatcttctacacaggtgcaaccaccaaccagcaaatcgtaccggcggtcagctggcttctcaagaatcgcggtaaaactttcttcctgttagggtcggactatgtatttccacgtacggcaaacaaaattattaaagcccaattgaaagcagaggggggccaggttgtcggtgaggaatataccccgttagggcatacagattacagtaccattatttcaaagatcaaacaggtcaagccggccgtagtatttaacaccctcaacggtgactcgaacgtagcttttttcaaacagcttaaggacgctgggattacccctaaagatgtcaccgttatgtccgtatctatcgcagaagaggaaattcgtgggattgggccagatgtcctggcaggtcacctcgccgtatggaactattttcaaactacagatacaccggaaaataaagcattcgttcagaagtataaagagaagtacggccaggatcgcgttactgacgacccaattgaggccgcctacaccgcagtacatttatgggcagaggcagttaagaaagcaggctctttcgacgtcgatcaggtaaagaaggccgcagctgggctggaatataaagcaccagagggtacagtgaaaattgatggtgagactcaacacttgtggaagaccgtgcgtatcggtgagattcaagccgacgggcagttcaaagagctctggaatagcggccaaccagttaaaccagatccatatttaaagtcatatccatgggcgaaagggctctcggaaggcggttcacatcatcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 118 - DNA, 1925 bp, Artificial Sequence
  Exemplary nucleotide sequence encoding psUBP11
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggctgaagaaagtgataatgtagatagtgctgacgccgaggaagacgactcggacgtctggtggggtggtgctgacaccgattatgctgacgggtcagaagataaagtcgtggaggtagctgaggaagaagaagtcgccgaggtagaagaagaagaagccgatgatgacgaagacgacgaggacggtgatgaggttgaggaagaggccgaagagccatacgaggaggccactgaacgcaccactagtatcgcaacgacaaccaccactacaacagagtcagtcgaggaagtactcgaagtcctctttcaaggcccaaaggaaactgcacctacggcaggcgcgggtaatggcagcccaccagtagaagccgcgggcgacagcattaaggtcggcatcctccacagtctctcaggcaccatggcgatttccgaagtcagtgtgaaggacgcagaaatgttagccatcgaggaaatcaacgccgcagggggtgtactgggtaagcaaatcgagcctgttatcgaggacggcgcctccgactggccaacattcgcggaaaaggcaggtaaattacttcagcaagacaaggttgcagcggtatttggtgggtggacttcagccagtcgcaaagctatgctcccagtcttcgaacaaaaccatggtctgctcttttatccggtccaatacgaaggcctcgaatcttccccaaacatcttctacacgggcgcaacgactaatcaacagatcgtaccaagtgtatcctggctcttggagaatcgtggcaagaaaatgttcctcttggggtccgattacgtattcccgcgtactgcaaataaaattattaaagctcaattaacggcggaaggtggcgaattagccggcgaagagtacacccctttgggtcatacagacttctcaacaattattgcaaagatcaaggaggcaaagccagacatcgtgtacaatactctcaatggggatagtaatgtagcattctttaagcaactgaaagacgctgggactacaagtaaagatatgaccaccctctctgtttcggtcgcagaagaagaaatccgcggcattggtgcagacattttagaaggtcatttggccgcctggaactactatcagagcacagatactccagagaataaagccttcgttgataaatataaagctaagtatggtgcagaccgggtcacggccgacccaattgaagccggctataccgcagtctacctctggaaagcagcggtcgaaaaggcaggtactacagatgtagacaaagtcaaagaggccgctaaaggtattgagttcgctgccccagaggggaaggtcactattgatggcgacaatcaacacattcataagaccgtgcgtatcggtgaggtccaagcagacggccagtttaaagaattatggaactcgggggagccagtaaaaccggacccatatttaaaaacatatgactgggcaaaaggcttgtcgggggaaggtggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 119 - DNA, 1928 bp, Artificial Sequence
  Exemplary nucleotide sequence encoding teUBP12
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggcagaagaatcagataatgtagatagtgcagatgcagaagaagatgattcggatgtatggtgggggggtgcagataccgattacgccgacggttccgaagataaagtggtagaagtcgcagaggaagaggaagtcgcagaggttgaggaggaggaagccgatgacgatgaggatgatgaggacggtgacgaagtcgaagaagaggccgaggagccgtacgaggaggctactgaacggacaacttccattgccacgaccacgaccaccacaactgaatcagtagaagaagtattagaagtattattccaagggccaggcggcgacacaattaaagtaggtatcttgcattcccttagtggtaccatggccatctcagagaaaagcgtagtagacgcgacacagttagcgatcgaacaaattaatcaggccggtggcgtactcggcaagcagatccagcctatcttggaagacggggcatcggactggccaaccttcgctgaaaaagccacgaaattaatcgatcaggataaagtagtcgcagtcttcggggcatggacatccgcttctcgtaaggcagtactcccggtctttgaatccaaaaatcacatgttatggtacccggtccagtacgagggccaagaagcctccaagaatatcttctataccggggccgcgccaaatcagcaaatcgaaccggcggtggactggctcctgcagaataaaggtaaaaagttctttctcgtaggtagtgattacgtcttcccacggacagcaaacacaattattaaagcacagctcgcagcaaaagggggcgaaacagttggcgaagattatttaccactcggtaacaccgaagtcacaccgatcatcacccggattcgtaacgccctcccagacggtggggtaatctttaacactctcaatggcgactcgaacgtagctttttttaagcaattgcaaggtgccggtttaacgccagacaaataccctaccatgagcgtctcaattgcagaggaggaggtacaggctatcggggtcgaatacttgaagggtcactacgccgcttggaactacttcatgacggttgacaccccagaaaacaaatcctttgtagaggccttcaaggcgaaatttggtcaaaatcgtgtgacaaacgatccaatggaagcagcctacatcgccgtacacttatggaaacaagcagttgagcaagcagggaccgcagatgatctggagaaagtgcggcaagcagcaattggccagacctttaacgcgccagagggcccagtcaagatgtttgcaaatcaccatattagtaaaacagtacggatcggcgaggtaggcgaggatgggctcttcaagattgtatactccacaccacaaccggtagacccactgccttggaaccaattcgttgcagaaacaaaaggcttcgccgccgactggacacgtacagacgtagacaatccgggtaagttcaaggcagcgggtgctggcggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 120 - DNA, 1556 bp, Artificial Sequence
  Exemplary nucleotide sequence encoding csUBP7_26C
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggttgtatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 121 - DNA, 1583 bp, Artificial Sequence
  Exemplary nucleotide sequence encoding csUBP7_27C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgtgttcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 122 - DNA, 1583 bp, Artificial Sequence
  Exemplary nucleotide sequence encoding csUBP7_30C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctgtgaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 123 - DNA, 1583 bp, Artificial Sequence
  Exemplary nucleotide sequence encoding csUBP7_65C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctgtgactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 124 - DNA, 1583 bp, Artificial Sequence
  Exemplary nucleotide sequence encoding csUBP7_69C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgtgcttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 125 - DNA, 1583 bp, Artificial Sequence
  Exemplary nucleotide sequence encoding csUBP7_90C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttgcacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 126 - DNA, 1583 bp, Artificial Sequence
  Exemplary nucleotide sequence encoding csUBP7_91C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggtgctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 127 - DNA, 1583 bp, Artificial Sequence
  Exemplary nucleotide sequence encoding csUBP7_92C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctgcgcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 128 - DNA, 1583 bp, Artificial Sequence
  Exemplary nucleotide sequence encoding csUBP7_93C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcgtgcagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 129 - DNA, 1583 bp, Artificial Sequence
  Exemplary nucleotide sequence encoding csUBP7_95C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagttgtaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 130 - DNA, 1583 bp, Artificial Sequence
  Exemplary nucleotide sequence encoding csUBP7_111C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctgtccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 131 - DNA, 1583 bp, Artificial Sequence
  Exemplary nucleotide sequence encoding csUBP7_114C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggtttgttatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 132 - DNA, 1556 bp, Artificial Sequence
  Exemplary nucleotide sequence encoding csUBP7_115C
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtgtgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 133 - DNA, 1556 bp, Artificial Sequence
  Exemplary nucleotide sequence encoding csUBP7_116C
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtattgtggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 134 - DNA, 1556 bp, Artificial Sequence
  Exemplary nucleotide sequence encoding csUBP7_157C
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattgtgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 135 - DNA, 1556 bp, Artificial Sequence
  Exemplary nucleotide sequence encoding csUBP7_158C
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattattgtttcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 136 - DNA, 1583 bp, Artificial Sequence
  Exemplary nucleotide sequence encoding csUBP7_159C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtatgcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 137 - DNA, 1583 bp, Artificial Sequence
  Exemplary nucleotide sequence encoding csUBP7_186C
gccagtaagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattcggcgtaatc

SEQ ID NO: 138 - DNA, 1556 bp, Artificial Sequence
  Exemplary nucleotide sequence encoding csUBP7_211C
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgtgtggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 139 - DNA, 1556 bp, Artificial Sequence
  Exemplary nucleotide sequence encoding csUBP7_238C
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactcggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgtgtatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 140 - DNA, 1523 bp, Artificial Sequence
  Exemplary nucleotide sequence encoding bsUBP3_76C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggcattttgcattctttatcaggtaccatggcaatctcggaagtaagtgttcacgacgccgagctcattgcgatccaagaaatcaatcagaaggggggtgtcctcggtaagaaactcgaaccggtagtggaagatggtgcatccgactggcctacatatgcagagaaaatgcggaagctcttacagcaggataaagtagcagcagtattcggcgggtgtacctccgcgtcgcgtaaggcaatgcttccagtagtcgagcaaaataacgggctcttattttacccagtccagtacgaagggatggagacatcgccaaatatcttctatactggtgcaacaaccaaccaacaaatcgtcccagccgtagattggcttttgaagaataaagggaaaaaattcttcctcatcggtagtgactacgtcttcccgcgtaccgccaacaagattatcaaagcccaggtcaaagcggggggcggcgaaattgcgggtgaggagtacaccccattgggccacactaattattcaacactggtatccaaaatcaaggaaaaacaaccagatgtaatctttaatacactcaacggggactctaacgttgccttctttaagcagctcaaggatgcagggatcagcgctgacgatatgccggtaatgagcgcatctgtcgccgaggaggagatccgggggattgggccagacgtactcaaggggcattatgccgtgtggaactactttcaaactactaacaccagtgagaaccaaacattcgtcaaaaattataaaaagatgaacggtgacagccgcgtaactagcgatccaattgaggccgggtataacgcagtctatctctgggcggccgcagtagaaaaagctaagagttttgacgtggacaaggtcaagaaagccgcagatggtattagtttcaaggccccaggtggcaccgtaaagatcgatggtgatactcagcacttatataagaccgtacgcatcgggcagattacgggggatggtcagttcaaagaggtatggaatagtggtgaaccagtgaagccagatccgtatttgaagacctatgattgggcaaagggcctctccaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 141 - DNA, 1523 bp, Artificial Sequence
  Exemplary nucleotide sequence encoding bsUBP3_77C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggcattttgcattctttatcaggtaccatggcaatctcggaagtaagtgttcacgacgccgagctcattgcgatccaagaaatcaatcagaaggggggtgtcctcggtaagaaactcgaaccggtagtggaagatggtgcatccgactggcctacatatgcagagaaaatgcggaagctcttacagcaggataaagtagcagcagtattcggcgggtggtgttccgcgtcgcgtaaggcaatgcttccagtagtcgagcaaaataacgggctcttattttacccagtccagtacgaagggatggagacatcgccaaatatcttctatactggtgcaacaaccaaccaacaaatcgtcccagccgtagattggcttttgaagaataaagggaaaaaattcttcctcatcggtagtgactacgtcttcccgcgtaccgccaacaagattatcaaagcccaggtcaaagcggggggcggcgaaattgcgggtgaggagtacaccccattgggccacactaattattcaacactggtatccaaaatcaaggaaaaacaaccagatgtaatctttaatacactcaacggggactctaacgttgccttctttaagcagctcaaggatgcagggatcagcgctgacgatatgccggtaatgagcgcatctgtcgccgaggaggagatccgggggattgggccagacgtactcaaggggcattatgccgtgtggaactactttcaaactactaacaccagtgagaaccaaacattcgtcaaaaattataaaaagatgaacggtgacagccgcgtaactagcgatccaattgaggccgggtataacgcagtctatctctgggcggccgcagtagaaaaagctaagagttttgacgtggacaaggtcaagaaagccgcagatggtattagtttcaaggccccaggtggcaccgtaaagatcgatggtgatactcagcacttatataagaccgtacgcatcgggcagattacgggggatggtcagttcaaagaggtatggaatagtggtgaaccagtgaagccagatccgtatttgaagacctatgattgggcaaagggcctctccaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 142 - DNA, 1523 bp, Artificial Sequence
  Exemplary nucleotide sequence encoding bsUBP3_78C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggcattttgcattctttatcaggtaccatggcaatctcggaagtaagtgttcacgacgccgagctcattgcgatccaagaaatcaatcagaaggggggtgtcctcggtaagaaactcgaaccggtagtggaagatggtgcatccgactggcctacatatgcagagaaaatgcggaagctcttacagcaggataaagtagcagcagtattcggcgggtggacctgtgcgtcgcgtaaggcaatgcttccagtagtcgagcaaaataacgggctcttattttacccagtccagtacgaagggatggagacatcgccaaatatcttctatactggtgcaacaaccaaccaacaaatcgtcccagccgtagattggcttttgaagaataaagggaaaaaattcttcctcatcggtagtgactacgtcttcccgcgtaccgccaacaagattatcaaagcccaggtcaaagcggggggcggcgaaattgcgggtgaggagtacaccccattgggccacactaattattcaacactggtatccaaaatcaaggaaaaacaaccagatgtaatctttaatacactcaacggggactctaacgttgccttctttaagcagctcaaggatgcagggatcagcgctgacgatatgccggtaatgagcgcatctgtcgccgaggaggagatccgggggattgggccagacgtactcaaggggcattatgccgtgtggaactactttcaaactactaacaccagtgagaaccaaacattcgtcaaaaattataaaaagatgaacggtgacagccgcgtaactagcgatccaattgaggccgggtataacgcagtctatctctgggcggccgcagtagaaaaagctaagagttttgacgtggacaaggtcaagaaagccgcagatggtattagtttcaaggccccaggtggcaccgtaaagatcgatggtgatactcagcacttatataagaccgtacgcatcgggcagattacgggggatggtcagttcaaagaggtatggaatagtggtgaaccagtgaagccagatccgtatttgaagacctatgattgggcaaagggcctctccaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 143 - DNA, 1523 bp, Artificial Sequence
  Exemplary nucleotide sequence encoding bsUBP3_79C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggcattttgcattctttatcaggtaccatggcaatctcggaagtaagtgttcacgacgccgagctcattgcgatccaagaaatcaatcagaaggggggtgtcctcggtaagaaactcgaaccggtagtggaagatggtgcatccgactggcctacatatgcagagaaaatgcggaagctcttacagcaggataaagtagcagcagtattcggcgggtggacctcctgttcgcgtaaggcaatgcttccagtagtcgagcaaaataacgggctcttattttacccagtccagtacgaagggatggagacatcgccaaatatcttctatactggtgcaacaaccaaccaacaaatcgtcccagccgtagattggcttttgaagaataaagggaaaaaattcttcctcatcggtagtgactacgtcttcccgcgtaccgccaacaagattatcaaagcccaggtcaaagcggggggcggcgaaattgcgggtgaggagtacaccccattgggccacactaattattcaacactggtatccaaaatcaaggaaaaacaaccagatgtaatctttaatacactcaacggggactctaacgttgccttctttaagcagctcaaggatgcagggatcagcgctgacgatatgccggtaatgagcgcatctgtcgccgaggaggagatccgggggattgggccagacgtactcaaggggcattatgccgtgtggaactactttcaaactactaacaccagtgagaaccaaacattcgtcaaaaattataaaaagatgaacggtgacagccgcgtaactagcgatccaattgaggccgggtataacgcagtctatctctgggcggccgcagtagaaaaagctaagagttttgacgtggacaaggtcaagaaagccgcagatggtattagtttcaaggccccaggtggcaccgtaaagatcgatggtgatactcagcacttatataagaccgtacgcatcgggcagattacgggggatggtcagttcaaagaggtatggaatagtggtgaaccagtgaagccagatccgtatttgaagacctatgattgggcaaagggcctctccaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 144 - DNA, 1523 bp, Artificial Sequence
  Exemplary nucleotide sequence encoding bsUBP3_145C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggcattttgcattctttatcaggtaccatggcaatctcggaagtaagtgttcacgacgccgagctcattgcgatccaagaaatcaatcagaaggggggtgtcctcggtaagaaactcgaaccggtagtggaagatggtgcatccgactggcctacatatgcagagaaaatgcggaagctcttacagcaggataaagtagcagcagtattcggcgggtggacctccgcgtcgcgtaaggcaatgcttccagtagtcgagcaaaataacgggctcttattttacccagtccagtacgaagggatggagacatcgccaaatatcttctatactggtgcaacaaccaaccaacaaatcgtcccagccgtagattggcttttgaagaataaagggaaaaaattcttcctcatcggtagtgactacgtctgtccgcgtaccgccaacaagattatcaaagcccaggtcaaagcggggggcggcgaaattgcgggtgaggagtacaccccattgggccacactaattattcaacactggtatccaaaatcaaggaaaaacaaccagatgtaatctttaatacactcaacggggactctaacgttgccttctttaagcagctcaaggatgcagggatcagcgctgacgatatgccggtaatgagcgcatctgtcgccgaggaggagatccgggggattgggccagacgtactcaaggggcattatgccgtgtggaactactttcaaactactaacaccagtgagaaccaaacattcgtcaaaaattataaaaagatgaacggtgacagccgcgtaactagcgatccaattgaggccgggtataacgcagtctatctctgggcggccgcagtagaaaaagctaagagttttgacgtggacaaggtcaagaaagccgcagatggtattagtttcaaggccccaggtggcaccgtaaagatcgatggtgatactcagcacttatataagaccgtacgcatcgggcagattacgggggatggtcagttcaaagaggtatggaatagtggtgaaccagtgaagccagatccgtatttgaagacctatgattgggcaaagggcctctccaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 145 - DNA, 1523 bp, Artificial Sequence
  Exemplary nucleotide sequence encoding bsUBP3_172C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaagtaggcattttgcattctttatcaggtaccatggcaatctcggaagtaagtgttcacgacgccgagctcattgcgatccaagaaatcaatcagaaggggggtgtcctcggtaagaaactcgaaccggtagtggaagatggtgcatccgactggcctacatatgcagagaaaatgcggaagctcttacagcaggataaagtagcagcagtattcggcgggtggacctccgcgtcgcgtaaggcaatgcttccagtagtcgagcaaaataacgggctcttattttacccagtccagtacgaagggatggagacatcgccaaatatcttctatactggtgcaacaaccaaccaacaaatcgtcccagccgtagattggcttttgaagaataaagggaaaaaattcttcctcatcggtagtgactacgtcttcccgcgtaccgccaacaagattatcaaagcccaggtcaaagcggggggcggcgaaattgcgggtgaggagtacaccccatgtggccacactaattattcaacactggtatccaaaatcaaggaaaaacaaccagatgtaatctttaatacactcaacggggactctaacgttgccttctttaagcagctcaaggatgcagggatcagcgctgacgatatgccggtaatgagcgcatctgtcgccgaggaggagatccgggggattgggccagacgtactcaaggggcattatgccgtgtggaactactttcaaactactaacaccagtgagaaccaaacattcgtcaaaaattataaaaagatgaacggtgacagccgcgtaactagcgatccaattgaggccgggtataacgcagtctatctctgggcggccgcagtagaaaaagctaagagttttgacgtggacaaggtcaagaaagccgcagatggtattagtttcaaggccccaggtggcaccgtaaagatcgatggtgatactcagcacttatataagaccgtacgcatcgggcagattacgggggatggtcagttcaaagaggtatggaatagtggtgaaccagtgaagccagatccgtatttgaagacctatgattgggcaaagggcctctccaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 146 - DNA, 1580 bp, Artificial Sequence
  Exemplary nucleotide sequence encoding ctUBP6_95C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggttgaagaaccagtagataataaaccaggtaccgacacttcagcagaggacacgatcaaggtcggcattttacattcactgtctggcactatggcaatctccgaggtctccctcaaagatgccgaactcatggcaattgaagaaattaaccaagcaggtgggctcttaggtaaaaaaatcgaaccagtaattgaagacggggcctccgactggcctacattcgctgaaaaggcaaagaagttacttcaaaacgacaaagttgcaaccgtcttcggctgttgtacatccgcatcgcgtaaagctgtcttgccagtcttcgaggagaacaacgggttactgtggtatccggtacaatacgagggcatggaatcaagcccaaacattttttacacaggggccgctccgaatcagcagattgtaccagcagtggaatggctcttagaaaataaaggcaaacggttctttctccttggctcggattacgtattcccacgcacggcaaataagattattaaggcgcagctgtccgcaatcgggggggagcttattgccgaggaatacactccattgggtcacaccgactatagtaccattgtcaacaaaatcaagacggcgaagccggatgtagtattcaacacattgaacggggactccaacgttgccttctttaaacagctcaaagacgcggggatcacctccgaagacattaccgtatgttcagtcagcgtcgccgaagaagaaattcgtggcatcggggccgaaaatattaaggggcacctcgttagttggaactactaccaaaccaccgacaccccggaaaataaggagttcgtcgagaagtataaatcgaaatatgggagcgaccgcgtcaccgatgatccaattgaggcagcctacatcgccgtacacttatgggcagaagcagtcaagaaagcagggtcgtttgaagtagagaaagtgaaagaggccgccaagggcttagagtttaaagcgcctgaagggttagtaaagatcgagggggagaatcagcatctctggaagccagtccgtattggtgaagtacaggaggacggtttaatcaaggagatctggtcgaccagcgaagcagtccgtccggacccttacttgaaaacttacgattgggccaaaggcctcagcgatgggggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 147 - DNA, 1580 bp, Artificial Sequence
  Exemplary nucleotide sequence encoding ctUBP6_96C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggttgaagaaccagtagataataaaccaggtaccgacacttcagcagaggacacgatcaaggtcggcattttacattcactgtctggcactatggcaatctccgaggtctccctcaaagatgccgaactcatggcaattgaagaaattaaccaagcaggtgggctcttaggtaaaaaaatcgaaccagtaattgaagacggggcctccgactggcctacattcgctgaaaaggcaaagaagttacttcaaaacgacaaagttgcaaccgtcttcggctgttggtgttccgcatcgcgtaaagctgtcttgccagtcttcgaggagaacaacgggttactgtggtatccggtacaatacgagggcatggaatcaagcccaaacattttttacacaggggccgctccgaatcagcagattgtaccagcagtggaatggctcttagaaaataaaggcaaacggttctttctccttggctcggattacgtattcccacgcacggcaaataagattattaaggcgcagctgtccgcaatcgggggggagcttattgccgaggaatacactccattgggtcacaccgactatagtaccattgtcaacaaaatcaagacggcgaagccggatgtagtattcaacacattgaacggggactccaacgttgccttctttaaacagctcaaagacgcggggatcacctccgaagacattaccgtatgttcagtcagcgtcgccgaagaagaaattcgtggcatcggggccgaaaatattaaggggcacctcgttagttggaactactaccaaaccaccgacaccccggaaaataaggagttcgtcgagaagtataaatcgaaatatgggagcgaccgcgtcaccgatgatccaattgaggcagcctacatcgccgtacacttatgggcagaagcagtcaagaaagcagggtcgtttgaagtagagaaagtgaaagaggccgccaagggcttagagtttaaagcgcctgaagggttagtaaagatcgagggggagaatcagcatctctggaagccagtccgtattggtgaagtacaggaggacggtttaatcaaggagatctggtcgaccagcgaagcagtccgtccggacccttacttgaaaacttacgattgggccaaaggcctcagcgatgggggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 148 - DNA, 1580 bp, Artificial Sequence
  Exemplary nucleotide sequence encoding ctUBP6_97C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggttgaagaaccagtagataataaaccaggtaccgacacttcagcagaggacacgatcaaggtcggcattttacattcactgtctggcactatggcaatctccgaggtctccctcaaagatgccgaactcatggcaattgaagaaattaaccaagcaggtgggctcttaggtaaaaaaatcgaaccagtaattgaagacggggcctccgactggcctacattcgctgaaaaggcaaagaagttacttcaaaacgacaaagttgcaaccgtcttcggctgttggacatgtgcatcgcgtaaagctgtcttgccagtcttcgaggagaacaacgggttactgtggtatccggtacaatacgagggcatggaatcaagcccaaacattttttacacaggggccgctccgaatcagcagattgtaccagcagtggaatggctcttagaaaataaaggcaaacggttctttctccttggctcggattacgtattcccacgcacggcaaataagattattaaggcgcagctgtccgcaatcgggggggagcttattgccgaggaatacactccattgggtcacaccgactatagtaccattgtcaacaaaatcaagacggcgaagccggatgtagtattcaacacattgaacggggactccaacgttgccttctttaaacagctcaaagacgcggggatcacctccgaagacattaccgtatgttcagtcagcgtcgccgaagaagaaattcgtggcatcggggccgaaaatattaaggggcacctcgttagttggaactactaccaaaccaccgacaccccggaaaataaggagttcgtcgagaagtataaatcgaaatatgggagcgaccgcgtcaccgatgatccaattgaggcagcctacatcgccgtacacttatgggcagaagcagtcaagaaagcagggtcgtttgaagtagagaaagtgaaagaggccgccaagggcttagagtttaaagcgcctgaagggttagtaaagatcgagggggagaatcagcatctctggaagccagtccgtattggtgaagtacaggaggacggtttaatcaaggagatctggtcgaccagcgaagcagtccgtccggacccttacttgaaaacttacgattgggccaaaggcctcagcgatgggggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 149 - DNA, 1580 bp, Artificial Sequence
  Exemplary nucleotide sequence encoding ctUBP6_98C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggttgaagaaccagtagataataaaccaggtaccgacacttcagcagaggacacgatcaaggtcggcattttacattcactgtctggcactatggcaatctccgaggtctccctcaaagatgccgaactcatggcaattgaagaaattaaccaagcaggtgggctcttaggtaaaaaaatcgaaccagtaattgaagacggggcctccgactggcctacattcgctgaaaaggcaaagaagttacttcaaaacgacaaagttgcaaccgtcttcggctgttggacatcctgttcgcgtaaagctgtcttgccagtcttcgaggagaacaacgggttactgtggtatccggtacaatacgagggcatggaatcaagcccaaacattttttacacaggggccgctccgaatcagcagattgtaccagcagtggaatggctcttagaaaataaaggcaaacggttctttctccttggctcggattacgtattcccacgcacggcaaataagattattaaggcgcagctgtccgcaatcgggggggagcttattgccgaggaatacactccattgggtcacaccgactatagtaccattgtcaacaaaatcaagacggcgaagccggatgtagtattcaacacattgaacggggactccaacgttgccttctttaaacagctcaaagacgcggggatcacctccgaagacattaccgtatgttcagtcagcgtcgccgaagaagaaattcgtggcatcggggccgaaaatattaaggggcacctcgttagttggaactactaccaaaccaccgacaccccggaaaataaggagttcgtcgagaagtataaatcgaaatatgggagcgaccgcgtcaccgatgatccaattgaggcagcctacatcgccgtacacttatgggcagaagcagtcaagaaagcagggtcgtttgaagtagagaaagtgaaagaggccgccaagggcttagagtttaaagcgcctgaagggttagtaaagatcgagggggagaatcagcatctctggaagccagtccgtattggtgaagtacaggaggacggtttaatcaaggagatctggtcgaccagcgaagcagtccgtccggacccttacttgaaaacttacgattgggccaaaggcctcagcgatgggggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 150 - DNA, 1580 bp, Artificial Sequence
  Exemplary nucleotide sequence encoding ctUBP6_164C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggttgaagaaccagtagataataaaccaggtaccgacacttcagcagaggacacgatcaaggtcggcattttacattcactgtctggcactatggcaatctccgaggtctccctcaaagatgccgaactcatggcaattgaagaaattaaccaagcaggtgggctcttaggtaaaaaaatcgaaccagtaattgaagacggggcctccgactggcctacattcgctgaaaaggcaaagaagttacttcaaaacgacaaagttgcaaccgtcttcggctgttggacatccgcatcgcgtaaagctgtcttgccagtcttcgaggagaacaacgggttactgtggtatccggtacaatacgagggcatggaatcaagcccaaacattttttacacaggggccgctccgaatcagcagattgtaccagcagtggaatggctcttagaaaataaaggcaaacggttctttctccttggctcggattacgtatgtccacgcacggcaaataagattattaaggcgcagctgtccgcaatcgggggggagcttattgccgaggaatacactccattgggtcacaccgactatagtaccattgtcaacaaaatcaagacggcgaagccggatgtagtattcaacacattgaacggggactccaacgttgccttctttaaacagctcaaagacgcggggatcacctccgaagacattaccgtatgttcagtcagcgtcgccgaagaagaaattcgtggcatcggggccgaaaatattaaggggcacctcgttagttggaactactaccaaaccaccgacaccccggaaaataaggagttcgtcgagaagtataaatcgaaatatgggagcgaccgcgtcaccgatgatccaattgaggcagcctacatcgccgtacacttatgggcagaagcagtcaagaaagcagggtcgtttgaagtagagaaagtgaaagaggccgccaagggcttagagtttaaagcgcctgaagggttagtaaagatcgagggggagaatcagcatctctggaagccagtccgtattggtgaagtacaggaggacggtttaatcaaggagatctggtcgaccagcgaagcagtccgtccggacccttacttgaaaacttacgattgggccaaaggcctcagcgatgggggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 151 - DNA, 1580 bp, Artificial Sequence
  Exemplary nucleotide sequence encoding ctUBP6_191C
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatggttgaagaaccagtagataataaaccaggtaccgacacttcagcagaggacacgatcaaggtcggcattttacattcactgtctggcactatggcaatctccgaggtctccctcaaagatgccgaactcatggcaattgaagaaattaaccaagcaggtgggctcttaggtaaaaaaatcgaaccagtaattgaagacggggcctccgactggcctacattcgctgaaaaggcaaagaagttacttcaaaacgacaaagttgcaaccgtcttcggctgttggacatccgcatcgcgtaaagctgtcttgccagtcttcgaggagaacaacgggttactgtggtatccggtacaatacgagggcatggaatcaagcccaaacattttttacacaggggccgctccgaatcagcagattgtaccagcagtggaatggctcttagaaaataaaggcaaacggttctttctccttggctcggattacgtattcccacgcacggcaaataagattattaaggcgcagctgtccgcaatcgggggggagcttattgccgaggaatacactccatgtggtcacaccgactatagtaccattgtcaacaaaatcaagacggcgaagccggatgtagtattcaacacattgaacggggactccaacgttgccttctttaaacagctcaaagacgcggggatcacctccgaagacattaccgtatgttcagtcagcgtcgccgaagaagaaattcgtggcatcggggccgaaaatattaaggggcacctcgttagttggaactactaccaaaccaccgacaccccggaaaataaggagttcgtcgagaagtataaatcgaaatatgggagcgaccgcgtcaccgatgatccaattgaggcagcctacatcgccgtacacttatgggcagaagcagtcaagaaagcagggtcgtttgaagtagagaaagtgaaagaggccgccaagggcttagagtttaaagcgcctgaagggttagtaaagatcgagggggagaatcagcatctctggaagccagtccgtattggtgaagtacaggaggacggtttaatcaaggagatctggtcgaccagcgaagcagtccgtccggacccttacttgaaaacttacgattgggccaaaggcctcagcgatgggggtagtcatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 152 - DNA, 1541 bp, Artificial Sequence
  Exemplary nucleotide sequence encoding csUBP7_186C.1
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatccaggagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaactataagaaaatgtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 153 - DNA, 1568 bp, Artificial Sequence
  Exemplary nucleotide sequence encoding csUBP7_186C.2
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacaagcgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 154 - DNA, 1568 bp, Artificial Sequence
  Exemplary nucleotide sequence encoding csUBP7_186C.3
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccaggcggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 155 - DNA, 1541 bp, Artificial Sequence
  Exemplary nucleotide sequence encoding csUBP7_186C.4
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatcagggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 156 - DNA, 1541 bp, Artificial Sequence
  Exemplary nucleotide sequence encoding csUBP7_186C.5
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgatggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 157 - DNA, 1541 bp, Artificial Sequence
  Exemplary nucleotide sequence encoding csUBP7_186C.6
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgcgggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 158 - DNA, 1541 bp, Artificial Sequence
  Exemplary nucleotide sequence encoding csUBP7_186C.7
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatcattgaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgcggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 159 - DNA, 1568 bp, Artificial Sequence
  Exemplary nucleotide sequence encoding csUBP7_186C.8
aagcttcggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgagcggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcggaattc

SEQ ID NO: 160 - DNA, 1541 bp, Artificial Sequence
  Exemplary nucleotide sequence encoding csUBP7_186C.9
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttagctatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 161 - DNA, 1541 bp, Artificial Sequence
  Exemplary nucleotide sequence encoding csUBP7_186C.10
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttaactatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 162 - DNA, 1541 bp, Artificial Sequence
  Exemplary nucleotide sequence encoding csUBP7_186C.11
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggaccgcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 163 - DNA, 1541 bp, Artificial Sequence
  Exemplary nucleotide sequence encoding csUBP7_186C.12
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttcgcgccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 164 - DNA, 1541 bp, Artificial Sequence
  Exemplary nucleotide sequence encoding csUBP7_186C.13
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggatgcggtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 165 - DNA, 1541 bp, Artificial Sequence
  Exemplary nucleotide sequence encoding csUBP7_186C.14
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtagcgccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 166 - DNA, 1541 bp, Artificial Sequence
  Exemplary nucleotide sequence encoding csUBP7_186C.15
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggcgcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 167 - DNA, 1541 bp, Artificial Sequence
  Exemplary nucleotide sequence encoding csUBP7_186C.16
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccgacccagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 168 - DNA, 1541 bp, Artificial Sequence
  Exemplary nucleotide sequence encoding csUBP7_186C.17
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccgaaccagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 169 - DNA, 1541 bp, Artificial Sequence
  Exemplary nucleotide sequence encoding csUBP7_186C.18
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccgcagcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 170 - DNA, 1541 bp, Artificial Sequence
  Exemplary nucleotide sequence encoding csUBP7_186C.19
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccgcatcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 171 - DNA, 1541 bp, Artificial Sequence
  Exemplary nucleotide sequence encoding csUBP7_186C.20
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgcgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 172 - DNA, 1541 bp, Artificial Sequence
  Exemplary nucleotide sequence encoding csUBP7_186C.21
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgattatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 173 - DNA, 1541 bp, Artificial Sequence
  Exemplary nucleotide sequence encoding csUBP7_186C.22
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgaatatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 174 - DNA, 1541 bp, Artificial Sequence
  Exemplary nucleotide sequence encoding csUBP7_186C.23
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcattatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 175 - DNA, 1541 bp, Artificial Sequence
  Exemplary nucleotide sequence encoding csUBP7_186C.24
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttacctatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 176 - DNA, 1541 bp, Artificial Sequence
  Exemplary nucleotide sequence encoding csUBP7_186C.25
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggtttattatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 177 - DNA, 1541 bp, Artificial Sequence
  Exemplary nucleotide sequence encoding csUBP7_186C.26
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttatgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 178 - DNA, 1541 bp, Artificial Sequence
  Exemplary nucleotide sequence encoding csUBP7_186C.27
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttctgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 179 - DNA, 1541 bp, Artificial Sequence
  Exemplary nucleotide sequence encoding csUBP7_186C.28
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctggcgggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 180 - DNA, 1541 bp, Artificial Sequence
  Exemplary nucleotide sequence encoding csUBP7_186C.29
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgcagggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 181 - DNA, 1541 bp, Artificial Sequence
  Exemplary nucleotide sequence encoding csUBP7_186C.30
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgagcggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 182 - DNA, 1541 bp, Artificial Sequence
  Exemplary nucleotide sequence encoding csUBP7_186C.31
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctggatggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 183 - DNA, 1541 bp, Artificial Sequence
  Exemplary nucleotide sequence encoding csUBP7_186C.32
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctggaaggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 184 - DNA, 1541 bp, Artificial Sequence
  Exemplary nucleotide sequence encoding csUBP7_186C.33
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgcatggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 185 - DNA, 1541 bp, Artificial Sequence
  Exemplary nucleotide sequence encoding csUBP7_186C.34
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaccggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 186 - DNA, 1541 bp, Artificial Sequence
  Exemplary nucleotide sequence encoding csUBP7_186C.35
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgctgggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 187 - DNA, 1541 bp, Artificial Sequence
  Exemplary nucleotide sequence encoding csUBP7_186C.36
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtggcgatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 188 - DNA, 1541 bp, Artificial Sequence
  Exemplary nucleotide sequence encoding csUBP7_186C.37
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgaacatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 189 - DNA, 1541 bp, Artificial Sequence
  Exemplary nucleotide sequence encoding csUBP7_186C.38
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgcagatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 190 - DNA, 1541 bp, Artificial Sequence
  Exemplary nucleotide sequence encoding csUBP7_186C.39
cgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgcatatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttg

SEQ ID NO: 191 - DNA, 1628 bp, Artificial Sequence
  Exemplary nucleotide sequence encoding csUBP7_26C_bZif
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggttgtatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactgggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggcggcagcggcggcagcaccggcgaaaaaccgtataaatgtccggaatgtggcaaaagctttagccgcagcggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 192 - DNA, 1628 bp, Artificial Sequence
  Exemplary nucleotide sequence encoding csUBP7_27C_bZif
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgtgttcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactgggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggcggcagcggcggcagcaccggcgaaaaaccgtataaatgtccggaatgtggcaaaagctttagccgcagcggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 193 - DNA, 1628 bp, Artificial Sequence
  Exemplary nucleotide sequence encoding csUBP7_30C_bZif
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctgtgaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactgggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggcggcagcggcggcagcaccggcgaaaaaccgtataaatgtccggaatgtggcaaaagctttagccgcagcggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 194 - DNA, 1628 bp, Artificial Sequence
  Exemplary nucleotide sequence encoding csUBP7_95C_bZif
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagttgtaaagccgtactcccagtcgtcgaagaaaataatgggcttctcttctatccggttcagtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccactgggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggcggcagcggcggcagcaccggcgaaaaaccgtataaatgtccggaatgtggcaaaagctttagccgcagcggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 195 - DNA, 1628 bp, Artificial Sequence
  Exemplary nucleotide sequence encoding csUBP7_186C.20_bZif
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgcgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggcggcagcggcggcagcaccggcgaaaaaccgtataaatgtccggaatgtggcaaaagctttagccgcagcggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 196 - DNA, 1583 bp, Artificial Sequence
  Exemplary nucleotide sequence encoding csUBP7_186C.114A_Imm1
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgcgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggcggcagcaaaaaaaaaaaaaaaaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 197 - DNA, 1583 bp, Artificial Sequence
  Exemplary nucleotide sequence encoding csUBP7_186C.114A_Imm2
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgcgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcatggcggcagcaaaaaaaaaaaaaaaaaataatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 198 - DNA, 1595 bp, Artificial Sequence
  Exemplary nucleotide sequence encoding csUBP7_186C.114A_Imm3
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgcgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcatggcggcagcaaaaaaaaaaaaaaaaaaaaaaaaaaaaaataatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 199 - DNA, 1580 bp, Artificial Sequence
  Exemplary nucleotide sequence encoding csUBP7_186C.114A_Imm4
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaaaaaaaaaaaaaaaaaggcggcagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgcgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 200 - DNA, 1592 bp, Artificial Sequence
  Exemplary nucleotide sequence encoding csUBP7_186C.114A_Imm5
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgaaaaaaaaaaaaaaaaaaaaaaaaaaaaaaggcggcagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgcgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 201 - DNA, 1670 bp, Artificial Sequence
  Exemplary nucleotide sequence encoding csUBP7_186C.114A_Imm6
cggtcacgcttgggactgccataggctggcccggtgatgccggccacgatgcgtccggcgtagaggatcgagatctcgatcccgcgaaattaatacgactcactatagggagaccacaacggtttccctctagaaataattttgtttaactttaagaaggagatataccatgagttcatcagaatcagaaaaagaaaaaagtgaagagaccatcaaagtagggattctccacagcttgagtggtacgatgtcaatctcagaagtttccttaaaagatgccgaattaatggcgatcgaagagatcaacaataatggcggtgtgttaggtaaaaagttagaaccgatcgtggaagatggcgcctcagactggccgaccttcgctgaaaaggctaagaaacttttacagaaggacaaggtggcagtaattttcggcgcttggacctcggcaagtcgcaaagccgtactcccagtcgtcgaagaaaataatgggcttctcttctatccggttgcgtatgaaggtctcgaaagttccccaaatatcttttacatgggcgccgccccaaaccagcagatcgtgccagcagttaaatggctcttcgacaacggtaagaagcgtttctacctcttgggctcggattatgtattcccacgcacagcaaacaagattattaaggcatacctcaaatacctcggcggtgttgtagtaggtgaagaatacaccccatgtggtcacactgactatagttctgtcattaataaaatcaaagccgcaaagccagacgtcgtatttaacactctgaacggggatagtaatgtagcctttttcaagcaattaaaggatgccgggattgacgcaaatacactccctgtcatgagcgtgagcatcgccgaggaggagatcaaaggcattggtccagagtatttaaaaggtcatctggtcacatggaactatttccaaagtgtagatacaccggaaaacaaggagttcgttgagaaatataagaaaaagtatggggaggaccgggtgacagatgacccaatcgaggcggcatacatcggcgtatacttatgggctaaagcggttgagaaggcggggtcgacagacgtggataaggtccgggaggccgcgaagggcatcgaatttaacgccccagagggcccagtaaagattgacggcgacaaccagcacctctacaagacggtgcgtattggtgagatcctggagaacggtcaaattcgtgagttgtggaaaacaaataaaccagttaaaccagatccatatttaaaaggttatgaatgggcacaggggttaagcgagcaaggcggcagcggcggcagcaccggcgaaaaaccgtataaatgtccggaatgtggcaaaagctttagccgcagcgatcatctgagccgccatcagcgcacccatcagaacaaaaaaggtggttcacatcatcatcatcatcattaatgaaagggcgatatccagcacactggcggccgttactagtggatccggctgctaacaaagcccgaaaggaagctgagttggctgctgccaccgctgagcaataactagcataaccccttggggcctctaaacgggtcttgaggggttttttgctgaaaggaggaactatatccggagcgactcccacggcacgttggcaagctcg

SEQ ID NO: 202 - protein, 385 aa, Anabaena variabilis
MGSHQERPLIGLLFSETGVTADIERSQRYGALLAVEQLNREGGVGGRPIETLSQDPGGDPDRYRLCAEDFIRNRGVRFLVGCYMSHTRKAVMPVVERADALLCYPTPYEGFEYSPNIVYGGPAPNQNSAPLAAYLIRHYGERVVFIGSDYIYPRESNHVMRHLYRQHGGTVLEEIYIPLYPSDDDLQRAVERIYQARADVVFSTVVGTGTAELYRAIARRYGDGRRPPIASLTTSEAEVAKMESDVAEGQVVVAPYFSSIDTPASRAFVQACHGFFPENATITAWAEAAYWQTLLLGRAAQAAGNWRVEDVQRHLYDIDIDAPQGPVRVERQNNHSRLSSRIAEIDARGVFQVRWQSPEPIRPDPYVVVHNLDDWSASMGGGPLP

SEQ ID NO: 203 - protein, 5 aa, Artificial Sequence
  TMXIS (conserved sequence)
  misc_feature (3)..(3): Xaa can be any naturally occurring amino acid
TMXIS

SEQ ID NO: 204 - protein, 5 aa, Artificial Sequence
  XXXXN (conserved sequence)
  misc_feature (1)..(4): Xaa can be any naturally occurring amino acid
XXXXN

SEQ ID NO: 205 - protein, 6 aa, Artificial Sequence
  ASXXXX (conserved sequence)
  misc_feature (3)..(6): Xaa can be any naturally occurring amino acid
ASXXXX

SEQ ID NO: 206 - protein, 7 aa, Artificial Sequence
  WTSXSRK (conserved sequence)
  misc_feature (4)..(4): Xaa can be any naturally occurring amino acid
WTSXSRK

SEQ ID NO: 207 - protein, 7 aa, Artificial Sequence
  YPVQXEG (conserved sequence)
  misc_feature (5)..(5): Xaa can be any naturally occurring amino acid
YPVQXEG

SEQ ID NO: 208 - protein, 8 aa, Artificial Sequence
  YVXPRTAX (conserved sequence)
  misc_feature (3)..(3): Xaa can be any naturally occurring amino acid
  misc_feature (8)..(8): Xaa can be any naturally occurring amino acid
YVXPRTAX

SEQ ID NO: 209 - protein, 4 aa, Artificial Sequence
  PXGX (conserved sequence)
  misc_feature (2)..(2): Xaa can be any naturally occurring amino acid
  misc_feature (4)..(4): Xaa can be any naturally occurring amino acid
PXGX

SEQ ID NO: 210 - protein, 8 aa, Artificial Sequence
  TXNGDXNV (conserved sequence)
  misc_feature (2)..(2): Xaa can be any naturally occurring amino acid
  misc_feature (6)..(6): Xaa can be any naturally occurring amino acid
TXNGDXNV

SEQ ID NO: 211 - protein, 6 aa, Artificial Sequence
  SXXEXE (conserved sequence)
  misc_feature (2)..(3): Xaa can be any naturally occurring amino acid
  misc_feature (5)..(5): Xaa can be any naturally occurring amino acid
SXXEXE

SEQ ID NO: 212 - protein, 400 aa, Artificial Sequence
  mpUBP1 (with signal peptide replaced with M and C75A, C385A, and C395A mutations)
MKVGVLHSLSGTMAISETTLKDTVLMMVEEQNKKGGLLGKKLEAVVVDPASNWPLFAEKARELLTEDQVDVIFGAWTSVSRKSVLPVIEELNGLMFYPVQYEGEESSYNVFYTGAAPNQQAIPAVNYLKDELGVERWVLAGTDYVYPRTTNKILEAYLKDMGVAEDDIMINYTPFGHSDWQSIVSDIKKFGSAGKKTAVVSTINGDANVPFYKELGNQGISSEDIPVVAFSVGEEELSGLDTAPLVGHLAAWNYFQSVETDENEEFITKWQAYTKNPERVTNDPMEATFIGFNMWANAVTEAGTTDVDAVEKAMIGQETPNLTGGIAVMNKNHHLSKPVLIGEIQDDGQFETVWETDGVVPGDAWSDFLPGSKDLVADWTDPLKAGNYNTETKMASGQNY

SEQ ID NO: 213 - protein, 405 aa, Artificial Sequence
  mhUBP2 (with signal peptide replaced with M and C385A and C395A mutations)
MKVGILHSLSGTMAISETALKDTMLMLIEKQNEAGGVLGRQLEPVVVDPASNWPLFAEKARELLEKEKVDVIFGNWTSVSRKSVLPVVEELNGLLFYPVQYEGEESSENVFYTGAAPNQQAIPAVDYLMNDLGVERWVLAGTDYVYPRTTNKILETYLKDKGVAAGDIMINYTPFGHSDWQTIVSDIKKFGSAGKKTAVVSTINGDANVPFYRELGNQGISATDIPVVAFSVGEQELSGIDTAPLVGHLAAWNYFMSVDNDANYDFIDAWVAYKGDDAAVTNDPMEAHYIGFNMYVEAVKKAGTTDVDEVKDAIIGVSVPNLTGGYATMMPNHHITKPVLIGEIQDNGQFSVVWETPSTVAGDAWSDFLPGSKDLISDWRAPLRAGNFNVVTGKAGGGSADVASN

SEQ ID NO: 214 - protein, 369 aa, Artificial Sequence
  bsUBP3 (with signal peptide replaced with M)
MKVGILHSLSGTMAISEVSVHDAELIAIQEINQKGGVLGKKLEPVVEDGASDWPTYAEKMRKLLQQDKVAAVFGGWTSASRKAMLPVVEQNNGLLFYPVQYEGMETSPNIFYTGATTNQQIVPAVDWLLKNKGKKFFLIGSDYVFPRTANKIIKAQVKAGGGEIAGEEYTPLGHTNYSTLVSKIKEKQPDVIFNTLNGDSNVAFFKQLKDAGISADDMPVMSASVAEEEIRGIGPDVLKGHYAVWNYFQTTNTSENQTFVKNYKKMNGDSRVTSDPIEAGYNAVYLWAAAVEKAKSFDVDKVKKAADGISFKAPGGTVKIDGDTQHLYKTVRIGQITGDGQFKEVWNSGEPVKPDPYLKTYDWAKGLSK

SEQ ID NO: 215 - protein, 371 aa, Artificial Sequence
  dcUBP4 (with signal peptide replaced with M)
MTIKVGILHSLSGTMAISEVSVKDAELMAIEEINASGGLLGKKIEPVIEDGASDWPTFAEKAKKLLQQDKVAVIFGGWTSASRKAMLPVVEENNGLLFYPVQYEGLESSPNIFYTGAEPSQQIVPAVSWLLENRGKKFYLLGSDYVFPRTANKIIKAQLKAKGGEVVGEEYTPLGHTDYSTIINKIKAAKPEIIFNTLNGDSNVAFFKQLKDAGITSKDITVMSVSIAEEEIRGIGPQNIAGHLAVWNYFQTTDTPENKEFVKKFKTKYGQDRVTDDPIEAGYFGVYLWAEAVKKANSTDVGKVKEAIKTVEFQAPEGLVKINGENQHTWKTVRIGEVQPDGQFKELWNSGGPVKPDPYLKGYEWAKGLSN

SEQ ID NO: 216 - protein, 392 aa, Artificial Sequence
  gtUBP5 (with signal peptide replaced with M)
MASSAVDEVKEKPKETSASETGDTVKVGILHSLSGTMAISEVSLRDAELMAIEEINKSGGLLGKKIEPVIEDGASDWPTFAEKAKKLLQKDKVAAIFGGWTSASRKAMLPVVEQNNGLLWYPVQYEGMESSPNIFYTGATTNQQIVPAVSWLLENRGKRFFLLGSDYVFPRTANKIIKAQLKAEGGQLVGEEYTPLGHTDYSTIINKIKEVKPDVVFNTLNGDSNVAFFKQLKDAGITAKDVTVMSVSIAEEEIRGIGGDVLAGHLAVWNYFQSTDTPENKAFVEKYKKKYGKERVTDDPIEAAYFAVHLWAEAVKKAGSFDVDKVKKAADGIEYKAPGGTVKIDGETQHTWKIVRIGEIQANGQFKELWNSGKAVKPDPYLKSYPWAKNLN

SEQ ID NO: 217 - protein, 388 aa, Artificial Sequence
  ctUBP6 (with signal peptide replaced with M)
MVEEPVDNKPGTDTSAEDTIKVGILHSLSGTMAISEVSLKDAELMAIEEINQAGGLLGKKIEPVIEDGASDWPTFAEKAKKLLQNDKVATVFGCWTSASRKAVLPVFEENNGLLWYPVQYEGMESSPNIFYTGAAPNQQIVPAVEWLLENKGKRFFLLGSDYVFPRTANKIIKAQLSAIGGELIAEEYTPLGHTDYSTIVNKIKTAKPDVVFNTLNGDSNVAFFKQLKDAGITSEDITVCSVSVAEEEIRGIGAENIKGHLVSWNYYQTTDTPENKEFVEKYKSKYGSDRVTDDPIEAAYIAVHLWAEAVKKAGSFEVEKVKEAAKGLEFKAPEGLVKIEGENQHLWKPVRIGEVQEDGLIKEIWSTSEAVRPDPYLKTYDWAKGLSD

SEQ ID NO: 218 - protein, 384 aa, Artificial Sequence
  csUBP7 (with signal peptide replaced with M and a C89A substitution)
MSSSESEKEKSEETIKVGILHSLSGTMSISEVSLKDAELMAIEEINNNGGVLGKKLEPIVEDGASDWPTFAEKAKKLLQKDKVAVIFGAWTSASRKAVLPVVEENNGLLFYPVQYEGLESSPNIFYMGAAPNQQIVPAVKWLFDNGKKRFYLLGSDYVFPRTANKIIKAYLKYLGGVVVGEEYTPLGHTDYSSVINKIKAAKPDVVFNTLNGDSNVAFFKQLKDAGIDANTLPVMSVSIAEEEIKGIGPEYLKGHLVTWNYFQSVDTPENKEFVEKYKKKYGEDRVTDDPIEAAYIGVYLWAKAVEKAGSTDVDKVREAAKGIEFNAPEGPVKIDGDNQHLYKTVRIGEILENGQIRELWKTNKPVKPDPYLKGYEWAQGLSEQ

SEQ ID NO: 219 - protein, 404 aa, Artificial Sequence
  taUBP8 (with signal peptide replaced with M and C141A and C402A substitutions)
MKSGYANRRDFIKASAAVITLHTIAPALVWPSPKKIKVGVLHSLSGTMAISEVHVKNATLLAIEEINRKGGVLGYTIEPIIEDGASDPATFAQKAQKLILMDKVVTVFGGWTSASRKAMLPVFERYKNLLWYPVQFEGNEASPNIIYTGAQPNQQILPALEWALKQGYKKFFLVGSDYVFPRTANLILKKHIQKNGAIVSGEEYVPLGGTDFSAVVNKIINTKPDIVFNTINGDSNVAFFKQMAAAGVGPKVLPVISFSIAEQEAKAIGIPLLEGSYAAWNYFMSLNNKANLEFIKAYQGKYGKSSLITDPMAHGYMNVYLWKMAVEKAGTFDPMMVRKAATELPWVDSPFGKIKIAKNQSLYQTAYIGKLGSDGQFSIVWSSGKPIEPEPYDKLVFPGKKAVL

SEQ ID NO: 220 - protein, 395 aa, Artificial Sequence
  gkUBP10 (with signal peptide replaced with M)
MASSAVDQAKNENKKDSSSASKEGDTVKVGILHSLSGTMAISEVSLRDAELMAIEEINASGGLLGKKIEPVVEDGASDWPTFAEKAKKLLQKDQVAAIFGGWTSASRKAMLPVVEQNNGLLWYPVQYEGMESSPNIFYTGATTNQQIVPAVSWLLKNRGKTFFLLGSDYVFPRTANKIIKAQLKAEGGQVVGEEYTPLGHTDYSTIISKIKQVKPAVVFNTLNGDSNVAFFKQLKDAGITPKDVTVMSVSIAEEEIRGIGPDVLAGHLAVWNYFQTTDTPENKAFVQKYKEKYGQDRVTDDPIEAAYTAVHLWAEAVKKAGSFDVDQVKKAAAGLEYKAPEGTVKIDGETQHLWKTVRIGEIQADGQFKELWNSGQPVKPDPYLKSYPWAKGLSE

SEQ ID NO: 221 - protein, 393 aa, Artificial Sequence
  psUBP11 (with signal peptide replaced with M)
MKETAPTAGAGNGSPPVEAAGDSIKVGILHSLSGTMAISEVSVKDAEMLAIEEINAAGGVLGKQIEPVIEDGASDWPTFAEKAGKLLQQDKVAAVFGGWTSASRKAMLPVFEQNHGLLFYPVQYEGLESSPNIFYTGATTNQQIVPSVSWLLENRGKKMFLLGSDYVFPRTANKIIKAQLTAEGGELAGEEYTPLGHTDFSTIIAKIKEAKPDIVYNTLNGDSNVAFFKQLKDAGTTSKDMTTLSVSVAEEEIRGIGADILEGHLAAWNYYQSTDTPENKAFVDKYKAKYGADRVTADPIEAGYTAVYLWKAAVEKAGTTDVDKVKEAAKGIEFAAPEGKVTIDGDNQHIHKTVRIGEVQADGQFKELWNSGEPVKPDPYLKTYDWAKGLSGE

SEQ ID NO: 222 - protein, 395 aa, Artificial Sequence
  teUBP12 (with signal peptide replaced with MAND C185A, C216A, and C481A substitutions)
MGGDTIKVGILHSLSGTMAISEKSVVDATQLAIEQINQAGGVLGKQIQPILEDGASDWPTFAEKATKLIDQDKVVAVFGAWTSASRKAVLPVFESKNHMLWYPVQYEGQEASKNIFYTGAAPNQQIEPAVDWLLQNKGKKFFLVGSDYVFPRTANTIIKAQLAAKGGETVGEDYLPLGNTEVTPIITRIRNALPDGGVIFNTLNGDSNVAFFKQLQGAGLTPDKYPTMSVSIAEEEVQAIGVEYLKGHYAAWNYFMTVDTPENKSFVEAFKAKFGQNRVTNDPMEAAYIAVHLWKQAVEQAGTADDLEKVRQAAIGQTFNAPEGPVKMFANHHISKTVRIGEVGEDGLFKIVYSTPQPVDPLPWNQFVAETKGFAADWTRTDVDNPGKFKAAGAG

SEQ ID NO: 223 - protein, 9 aa, Artificial Sequence
  GGSHHHHHH Sequence
GGSHHHHHH

SEQ ID NO: 224 - protein, 97 aa, Artificial Sequence
  Flag-acidic-target-tag (FATT) hyperacidic region
AEESDNVDSADAEEDDSDVWWGGADTDYADGSEDKVVEVAEEEEVAEVEEEEADDDEDDEDGDEVEEEAEEPYEEATERTTSIATTTTTTTESVEEV

SEQ ID NO: 225 - protein, 309 aa, Artificial Sequence
  ecGGBP (with signal peptide removed)
ADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNQADGKGAADGTNWKIDNKVVRVPYVGVDKDNLAEFSKK

SEQ ID NO: 226 - protein, 438 aa, Anabaena variabilis
MSRRINRRRFLIYGSATIGSSILLKACANNTPNATNSPSTSGNASPVAASGGNTIKIGILHSLSGTMSISEKSVVDAEKLAIKEINAAGGVLGKQIEAIVEDGASNWDTFREKATKLIDQDKVAVVFGCWTSASRKNVKPVFESKDHMLWYPVQYEGQECSKNIFYTGAAPNQQIEPSVDWLLKNKGKEFFLVGSDYVFPRTANTIIKAQLEALGGKTVGEDYLPLGNTEVTPIITKIKQTLPNGGVIYNTLNGDSNVAFFKQLKGAGLTPDKYPSMSVSIAEEEVKAIGVEYLKGHYAAWNYFQTVDTPANKKFVEAFKKEYGADRVTNDPMEAAYIAVYLWKQAVEKAGSPDLAKVRAAAYGQTIDAPEGKVTVNANHHISKVVRIGEVRDDGLFDIVYATPAPVEPVPWNQFVKETKGFACDWSDPAKGGKYKKA

SEQ ID NO: 227 - protein, 423 aa, Corynebacterium glutamicum
MSRPIVKQAFTVTAVTAMAFALASCTRAVDATSADGTASNTAASCVDTSGDSIKIGFINSLSGTMAISETTVNQSLHMAADEINAAGGVLGKQLEISEEDGASEPATFAERSQRLIQQECVAAVFGGWTSASRKAMLPVFEGNNSLLFYPVQYEGMESSPNIFYTGATTNQQIIPALDYLRENGLNRLFLVGSDYVFPRTANSIIKDYAEANGMEIVGEDYAPLGSTDFTTIANRMRDSNADAVFNTLNGDSNVAFFRQYNSLGFNADTLPVMSVSIAEEEVGGIGTANIEGQLVAWDYYQTIDTPENETFVENFKDLYGQDKVTSDPMEAAYTSLYLWKEMVEKADSFDVAAIQAAADGTTFDAPEGTVVVDGDNHHISKTPRIGRIRPDGLIDTIWETDSPVDPDPYLSSYDWAKTTAATS

SEQ ID NO: 228 - protein, 8 aa, Artificial Sequence
  Rhinovirus C3 protease cleavage site
LEVLFQGP

SEQ ID NO: 229 - protein, 109 aa, Escherichia coli
MSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLA

SEQ ID NO: 230 - protein, 118 aa, Artificial Sequence
  Adaptor0
MSAKIIHLTDDSFDTDVLKADGAILVAFWAEWCGPCKMIAPILDEIADEYQGKLTVAMLNIDQNPGTAPKYGIRGIPTLLLFKNGEVAATKVGALSKGQLKEFLDANLAGGSHHHHHH

SEQ ID NO: 231 - protein, 118 aa, Artificial Sequence
  Adaptor1.0
MSAKIIHLTDDSFDTDVLKADGAILVAFWAEWCGPCKMIAPILDEIADEYQGKLTVAMLNIDQNPGTAPKYGICGIPTLLLFKNGEVAATKVGALSKGQLKEFLDANLAGGSHHHHHH

SEQ ID NO: 232 - protein, 118 aa, Artificial Sequence; identical to SEQ ID NO: 231
  Adaptor2.0a

SEQ ID NO: 233 - protein, 118 aa, Artificial Sequence; identical to SEQ ID NO: 231
  Adaptor2.0b

SEQ ID NO: 234 - protein, 118 aa, Artificial Sequence
  Adaptor3.0
MSAKIIHLTDCSFDTDVLKADGAILVAFWAEWCGPCKMIAPILDEIADEYQGKLTVAMLNIDQNPGTAPKYGIRGIPTLLLFKNGEVAATKVGALSKGQLKEFLDANLAGGSHHHHHH

SEQ ID NO: 235 - protein, 118 aa, Artificial Sequence
  Adaptor4.0
MSAKIIHLTDDSFDCDVLKADGAILVAFWAEWCGPCKMIAPILDEIADEYQGKLTVAMLNIDQNPGTAPKYGIRGIPTLLLFKNGEVAATKVGALSKGQLKEFLDANLAGGSHHHHHH

SEQ ID NO: 236 - protein, 118 aa, Artificial Sequence
  Adaptor5.0
MSAKIIHLTDDSFDTDVLKACGAILVAFWAEWCGPCKMIAPILDEIADEYQGKLTVAMLNIDQNPGTAPKYGIRGIPTLLLFKNGEVAATKVGALSKGQLKEFLDANLAGGSHHHHHH

SEQ ID NO: 237 - protein, 118 aa, Artificial Sequence
  Adaptor6.0
MSAKIIHLTDDSFDTDVLKADGAILVAFWAECCGPCKMIAPILDEIADEYQGKLTVAMLNIDQNPGTAPKYGIRGIPTLLLFKNGEVAATKVGALSKGQLKEFLDANLAGGSHHHHHH

SEQ ID NO: 238 - protein, 118 aa, Artificial Sequence
  Adaptor7.0
MSAKIIHLTDDSFDTDVLKADGAILVAFWAEWCGPCKCIAPILDEIADEYQGKLTVAMLNIDQNPGTAPKYGIRGIPTLLLFKNGEVAATKVGALSKGQLKEFLDANLAGGSHHHHHH

SEQ ID NO: 239 - protein, 118 aa, Artificial Sequence
  Adaptor8.0
MSAKIIHLTDDSFDTDVLKADGAILVAFWAEWCGPCKMIAPILDCIADEYQGKLTVAMLNIDQNPGTAPKYGIRGIPTLLLFKNGEVAATKVGALSKGQLKEFLDANLAGGSHHHHHH

SEQ ID NO: 240 - protein, 118 aa, Artificial Sequence
  Adaptor9.0
MSAKIIHLTDDSFDTDVLKADGAILVAFWAEWCGPCKMIAPILDEIADEYQGCLTVAMLNIDQNPGTAPKYGIRGIPTLLLFKNGEVAATKVGALSKGQLKEFLDANLAGGSHHHHHH

SEQ ID NO: 241 - protein, 118 aa, Artificial Sequence
  Adaptor10.0
MSAKIIHLTDDSFDTDVLKADGAILVAFWAEWCGPCKMIAPILDEIADEYQGKLTVAMLNIDCNPGTAPKYGIRGIPTLLLFKNGEVAATKVGALSKGQLKEFLDANLAGGSHHHHHH

SEQ ID NO: 242 - protein, 118 aa, Artificial Sequence
  Adaptor11.0
MSAKIIHLTDDSFDTDVLKADGAILVAFWAEWCGPCKMIAPILDEIADEYQGKLTVAMLNIDQNPGTAPKCGIRGIPTLLLFKNGEVAATKVGALSKGQLKEFLDANLAGGSHHHHHH

SEQ ID NO: 243 - protein, 118 aa, Artificial Sequence
  Adaptor12.0
MSAKIIHLTDDSFDTDVLKADGAILVAFWAEWCGPCKMIAPILDEIADEYQGKLTVAMLNIDQNPGTAPKYGIRGIPTLLLFKNGECAATKVGALSKGQLKEFLDANLAGGSHHHHHH

SEQ ID NO: 244 - protein, 118 aa, Artificial Sequence
  Adaptor13.0
MSAKIIHLTDDSFDTDVLKADGAILVAFWAEWCGPCKMIAPILDEIADEYQGKLTVAMLNIDQNPGTAPKYGIRGIPTLLLFKNGEVAATKCGALSKGQLKEFLDANLAGGSHHHHHH

SEQ ID NO: 245 - protein, 118 aa, Artificial Sequence
  Adaptor14.0
MSAKIIHLTDDSFDTDVLKADGAILVAFWAEWCGPCKMIAPILDEIADEYQGKLTVAMLNIDQNPGTAPKYGIRGIPTLLLFKNGEVAATKVGALSCGQLKEFLDANLAGGSHHHHHH

SEQ ID NO: 246 - protein, 118 aa, Artificial Sequence
  Adaptor15.0
MSAKIIHLTDDSFDTDVLKADGAILVAFWAEWCGPCKMIAPILDEIADEYQGKLTVAMLNIDQNPGTAPKYGIRGIPTLLLFKNGEVAATKVGALSKGCLKEFLDANLAGGSHHHHHH

SEQ ID NO: 247 - protein, 118 aa, Artificial Sequence
  Adaptor16.0
MSAKIIHLTDDSFDTDVLKADGAILVAFWAEWCGPCKMIAPILDEIADEYQGKLTVAMLNIDQNPGTAPKYGIRGIPTLLLFKNGEVAATKVGALSKGQLKEFLDCNLAGGSHHHHHH

What is claimed is:

1. A biosensor for urea, comprising a urea-binding protein and a reporter group, wherein said urea-binding protein is at least 90% identical to SEQ ID NO: 18 and comprises primary complementary surface amino acids (PCS), wherein said PCS comprises residues selected from the group consisting of 92S, 111Y, 114Q, 157Y, 211N and 238S, and wherein said reporter group comprises a fluorophore and is functional to transduce a detectable signal when said biosensor binds to urea.

2. The biosensor of claim 1, wherein the reporter group is selected from the group consisting of:

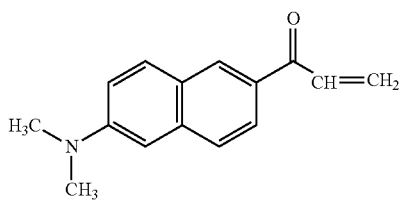 [SMILES: C=CC(=O)c1ccc2cc(N(C)C)ccc2c1]

6-Acryloyl-2-Dimethylaminonaphthalene,

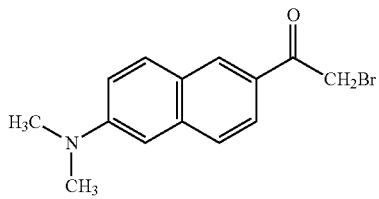

6-bromoacetyl-2-dimetylaminonaphtalene, and

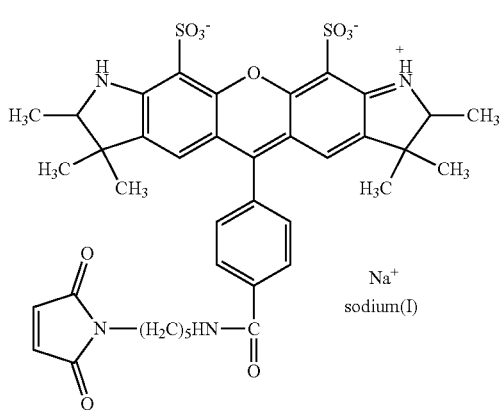

5-(4-((5-(2,5-dioxo-2,5-dihydro-1H-pyrrol-1-yl)pentyl) carbamoyl)phenyl)-2,3,3,7,7,8-hexamethyl-2,3,7,8-tetrahydro-1H-pyrano[3,2-f:5,6-f']diindol-9ium-10,12-disulfonate.

3. The biosensor of claim 1, wherein the reporter group is covalently attached to the urea-binding protein.

4. The biosensor of claim 1, wherein the reporter group is conjugated to a cysteine of the urea-binding protein.

5. A method of detecting the presence or concentration of a urea in a sample, the method comprising:
   (a) contacting the biosensor of claim 1 with the sample;
   (b) measuring a signal from the biosensor; and
   (c) comparing the signal to a control value, wherein a difference in signal indicates the presence of urea in the sample.

6. A method for monitoring the level of urea in a subject, comprising
   (a) administering a biosensor according to claim 1 or a device comprising a biosensor according to claim 1 to the subject, wherein after administration the biosensor is in contact with a bodily fluid or surface of the subject, and
   (b) detecting (i) a signal produced by a reporter group of the biosensor continuously or repeatedly at intervals less than about 30 minutes apart, and/or (ii) whether a signal is produced by a reporter group of the biosensor continuously or repeatedly at intervals less than about 30 minutes apart.

7. The biosensor of claim 2, wherein said reporter group is attached to a cysteine of said urea-binding protein.

8. The biosensor of claim 2, wherein the urea-binding protein comprises the amino acid sequence of SEQ ID NO: 32, and wherein said reporter group is attached to a cysteine of said urea-binding protein.

9. The biosensor of claim 2, wherein the urea-binding protein comprises the amino acid sequence of SEQ ID NO: 98, and wherein said reporter group is attached to a cysteine of said urea-binding protein.

10. The biosensor of claim 1, wherein the PCS further comprises one of 159 V or 159Y.

11. The biosensor of claim 1, wherein the PCS further comprises one of 113V or 113I or 113L.

12. The biosensor of claim 1, wherein the urea binding protein further comprises one or more mutations selected from the group consisting of T26X, M27X, S30X, E43X, S65X, T69X, W90X, T91X, S92X, A93X, R95X, Y111X, V113X, Q114X, Y115X, E116X, Y157X, V158X, F159X, L186X, N211X, S238X, E241X, K276X, K280X, D288X, and E329X, wherein X is any amino acid.

13. The biosensor of claim 11, wherein X is cysteine.

* * * * *